United States Patent
Venter et al.

(10) Patent No.: US 6,825,336 B1
(45) Date of Patent: Nov. 30, 2004

(54) POLYMORPHISMS IN KNOWN GENES ASSOCIATED WITH OSTEOPOROSIS, METHODS OF DETECTION AND USES THEREOF

(75) Inventors: J. Craig Venter, Rockville, MD (US); Jinghui N. Zhang, Rockville, MD (US); Xiangjun Liu, Olney, MD (US); William Rowe, Rockville, MD (US); Anibal Cravchik, Gaithersburg, MD (US); Francis Kalush, Rockville, MD (US); Ashwinikumar Naik, Gaithersburg, MD (US); Gangadharan Subramanian, Columbia, MD (US); Trevor Woodage, Washington, DC (US)

(73) Assignee: Applera Corporation, Norwalk, CT (US)

( * ) Notice: Subject to any disclaimer, the term of this patent is extended or adjusted under 35 U.S.C. 154(b) by 0 days.

(21) Appl. No.: 09/949,001

(22) Filed: Sep. 10, 2001

Related U.S. Application Data

(60) Provisional application No. 60/231,323, filed on Sep. 8, 2000.
(51) Int. Cl.[7] .............................................. C07H 21/04
(52) U.S. Cl. ................ 536/24.31; 536/23.3; 536/24.33; 536/23.1
(58) Field of Search ............................ 536/24.31, 23.3, 536/24.33, 23.1; 435/6, 91.2

(56) References Cited

U.S. PATENT DOCUMENTS

| | | | | | |
|---|---|---|---|---|---|
| 5,474,796 A | * | 12/1995 | Brennan | ..................... | 427/2.13 |
| 5,521,300 A | * | 5/1996 | Shah et al. | ............... | 536/24.32 |
| 5,622,839 A | * | 4/1997 | Moore et al. | ............... | 435/69.1 |

FOREIGN PATENT DOCUMENTS

EP  0889128  * 7/1999

OTHER PUBLICATIONS

Albrandt et al. (Endocrinology 136(12) 5377–5384).*
Fei et al. (Nucleic Acids Research, 1998, vol. 26, No. 11, pp. 2827–2828).*
Livak et al. (PCR Methods and Applications, vol. 4, pp. 357–362, 1995).*
Kox et al. (Journal of Clinical Microbiology, Dec. 1995, vol. 33, No. 12, p. 3225–3233).*

* cited by examiner

*Primary Examiner*—Gary Benzion
*Assistant Examiner*—Juliet C. Switzer
(74) *Attorney, Agent, or Firm*—Celera Genomics; Justin D. Karjala

(57) ABSTRACT

The present invention is based on the discovery of novel polymorphisms (SNPs) in the genes known in the art to contribute to osteoporosis. Such polymorphisms can lead to a variety of disorders that are mediated/modulated by a variant osteoporosis associated protein. The present invention provides reagents used for detecting and expressing the variant nucleic acid/protein sequence as well as methods of identifying and using these variants.

15 Claims, 1 Drawing Sheet

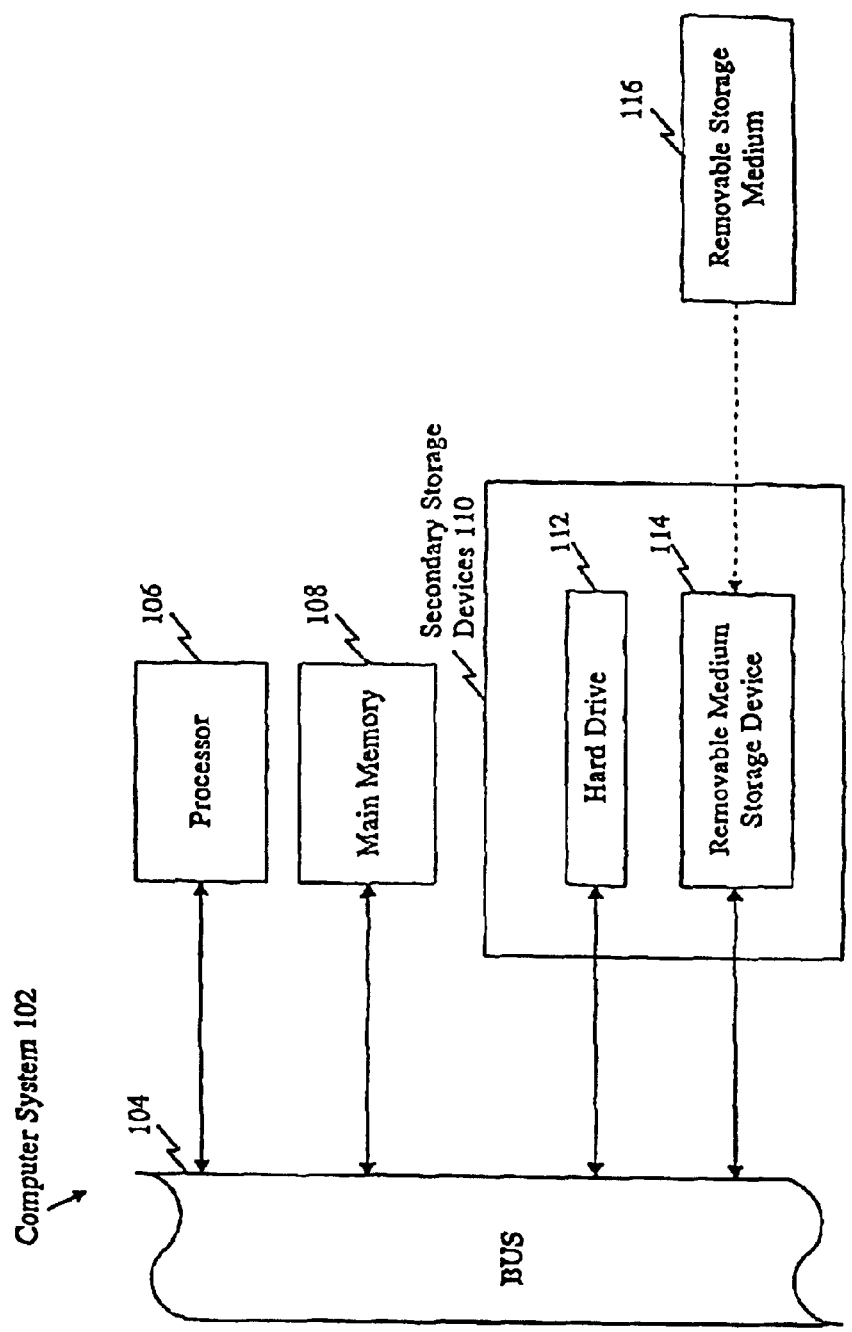
FIGURE SHEET 1

POLYMORPHISMS IN KNOWN GENES ASSOCIATED WITH OSTEOPOROSIS, METHODS OF DETECTION AND USES THEREOF

This application claims benefit of provisional application 60/231,323 filed Sep. 8, 2000.

FIELD OF THE INVENTION

The present invention is in the field of osteoporosis diagnosis and therapy. The present invention specifically provides previously unknown single nucleotide polymorphisms (SNPs) in genes that have been identified as being involved in pathologies associated with osteoporosis. Since these genes are known to be associated with osteoporosis, the presently disclosed naturally occurring polymorphisms (variants) are valuable for association and linkage analysis. Specifically, the identified SNPs are useful for such applications as screening for osteoporosis susceptibility, prevention of osteoporosis, development of diagnostics and therapies for osteoporosis, development of drugs for osteoporosis, and development of individualized drug treatments based on an individual's SNP profile. The SNPs provided by the present invention are also useful for human identification. Methods and reagents for detecting the presence of these polymorphisms are provided.

BACKGROUND OF THE INVENTION

Osteoporosis

The human bones are generally subdivided into cortical bone and cancellous bone. The cortical bone is dense osseous tissue and is represented by the diaphysis of appendicular skeleton in the form of pipes. On the other hand, cancellous bone consists mainly of trabeculae. Such cancellous bone is present, for example, in the epiphysial portions of long shaft bones, vertebrae, carpal bones, calcanei, tali, and tarsal bones. However, since cancellous bone has a larger surface in contact with soft tissue containing vasculatures, cancellous bone shows higher metabolic turn over and is predisposed to rapid changes under bone diseases or treatments.

Metabolic bone diseases include those conditions producing diffusely decreased bone density (osteopenia) and diminished bone strength. It is categorized by histologic appearance: osteoporosis which is common and defined by decreased mineral and bone matrix, and osteomalacia which is unusual and defined by decreased mineral but intact bone matrix.

Osteoporosis is the most common metabolic bone disease and the cause of hundreds of thousands of fractures every year. The morbidity and indirect mortality rates are very high. Since the usual form of the disease is clinically evident in middle life and beyond and since women are more frequently affected than men, it may be referred to as "postmenopausal" osteoporosis. It is characterized by a decrease in the amount of bone present to a level below which it is capable of maintaining the structural integrity of the skeleton. The rate of bone formation is often normal, whereas the rate of bone resorption is increased. There is a greater loss of trabecular bone than compact bone, accounting for the primary features of disease, i.e., crush fractures of vertebrae, fractures of the neck of the femur, and fractures of distal end of the radius. Whatever bone is present is normally mineralized.

The cause of osteoporosisare among, but not limited to the hormone deficiency (estrogen or androgen), hormone excess (cushing's syndrome or glucocorticoid administration, thyrotoxicosis, hyperparathyroidism, excessive vitamin D administration), immobilization, tabacco, malignancy, idiopathic or geriatric, and genetic disorders (Type I collagen mutations, Ehlers-danlos syndrome, Marfan's syndrome, Homocystinuria).

Among the genetic disorders, osteogenesis imperfecta is caused by a major mutation in the gene encoding for type I collagen, the major collagen constituent of bone. This causes severe osteoporosis. Marfan's syndrome is caused by mutations in fibrillin gene on chromosome 15. Homocytinuria is caused by cystathionine beta-synthase deficiency and exhibits an autosomal recessive pattern of inheritance.

Researchers believe that genetic factors play a dominant role in the etiology of this disease among the ethnic or gender difference. Several genes have been shown to be associated with low bone density and research has focused on identifying those genes that may act as markers of disease. Common allelic variations of the vitamin D receptor gene have been found to be associated with decreased bone density in certain populations, including premenopausal women and young girls (Wood, R. J. and Fleet, J. C. Ann. Rev. Nutrit. 1998 18:233–258). Bone mineral density has also been associated with genetic variation in the estrogen receptor gene, both by itself and in conjunction with variations in the vitamin D receptor gene (Willing et al. J. Bone Min. Res. 1998 13:695–705). In Japanese women, the HLA-A*24-B*07-DRB*01 halotype has been linked to low peak bone mass (Tsuji et al. Hum. Immunol.1998 59:243–249). A variant of the gene encoding transforming growth factor-beta 1 has also been associated with low bone mass in osteoporotic women and with low bone mass and increased bone turnover in normal women (Langdahl et al. Bone 1997 20:289–294). A polymorphism of the COLIAI gene has been identified as a potential marker for low bone mass and vertebral fracture in women (Grant et al. Nat. Genet. 1996 14:203–205). Devoto et al. (Eur. J. Hum. Genet. 1998 6:151–157) determined that there was a gene or genes on chromosome 1 of humans that was linked to low bone density. Polymorphisms linked to osteoporosis have been described in the TGF-91 gene, whose protein product is abundant in bone and an important regulator of bone resorption and formation (Langdahl et al., 1997; Yamada et al., 1998; WO97/28280). A polymorphism in the gene on chromosome 1 for tumor necrosis factor alpha receptor 2 has now been shown to be associated with low bone density. (Spotila et al. WO 0032826).

Genes associated with osteoporosis include, but not limit to: alcitonin receptor, collagen subunit (alpha-1 (X)) 3, Kuestner,et al Mol. Pharmacol. 46 (2), 246–255 (1994); insulin-like growth factor binding protein 1, Brewer et al., Biochem. Biophys. Res. Commun. 152 (3), 1289–1297 (1988), Brinkman et al., EMBO J. 7 (8), 2417–2423 (1988), Cubbage et al., Mol. Endocrinol. 3 (5), 846–851 (1989), Alitalo et al., Hum. Genet. 83 (4), 335–338 (1989), Ekstand et al.,Genomics 6 (3), 413–418 (1990), Suwanichkul et al., J. Biol. Chem. 265 (34), 21185–21193 (1990), Ehrenborg et al., Genomics 12 (3), 497–502 (1992); insulin-like growth factor 1 receptor beta chain, Francke et al., Cold Spring Harb. Symp. Quant. Biol. 51, 855–866 (1986), Ullrich et al., EMBO J. 5 (10), 2503–2512 (1986), Flier et al., Proc. Natl. Acad. Sci. U.S.A. 83 (3), 664–668 (1986), Abbott et al., J. Biol. Chem. 267 (15), 10759–10763 (1992), Werner et al., Proc. Natl. Acad. Sci. U.S.A. 93 (16), 8318–8323 (1996), Grant et al., J. Clin. Endocrinol. Metab. 83 (9), 3252–3257 (1998); interleukin 4 receptor, Idzerda et al., J. Exp. Med. 171 (3), 861–873 (1990), Pritchard et al., Genomics 10 (3), 801–806 (1991); Werner syndrome, Goto et al., Nature 355 (6362), 735–738 (1992).

Diagnosis of osteoporosis is most often done in conjunction with a study of bone density by radiography. Although clinical laboratory tests such as levels of calcium and phosphorus in blood can be examined, these measures are usually normal in osteoporotic patients. Only about 20% of postmenopausal women with osteoporosis exhibit hypercalciuria, or increased excretion of calcium in urine.

Therefore, such laboratory findings are not indicative of the presence of disease, and clearly would not be indicative of risk of developing disease. To date, the prediction of risk of developing disease relies on family history of the disease. However, no genetic test is currently available to screen individuals.

SNPs

The genomes of all organisms undergo spontaneous mutation in the course of their continuing evolution, generating variant forms of progenitor sequences (Gusella, Ann. Rev. Biochem. 55, 831–854 (1986)). The variant form may confer an evolutionary advantage or disadvantage relative to a progenitor form or may be neutral. In some instances, a variant form confers a lethal disadvantage and is not transmitted to subsequent generations of the organism. In other instances, a variant form confers an evolutionary advantage to the species and is eventually incorporated into the DNA of many or most members of the species and effectively becomes the progenitor form. Additionally, the effect of a variant form may be both beneficial and detrimental, depending on the circumstances. For example, a heterozygous sickle cell mutation confers resistance to malaria, but a homozygous sickle cell mutation is usually lethal. In many instances, both progenitor and variant form(s) survive and co-exist in a species population. The coexistence of multiple forms of a sequence gives rise to polymorphisms, such as SNPs.

The reference allelic form is arbitrarily designated and may be, for example, the most abundant form in a population, or the first allelic form to be identified, and other allelic forms are designated as alternative, variant or polymorphic alleles. The allelic form occurring most frequently in a selected population is sometimes referred to as the "wild type" form.

Approximately 90% of all polymorphisms in the human genome are single nucleotide polymorphisms (SNPs). SNPs are single base pair positions in DNA at which different alleles, or alternative nucleotides, exist in some population. The SNP position, or SNP site, is usually preceded by and followed by highly conserved sequences of the allele (e.g., sequences that vary in less than $\frac{1}{100}$ or $\frac{1}{1000}$ members of the populations). An individual may be homozygous or heterozygous for an allele at each SNP position. As defined by the present invention, the least frequent allele at a SNP position can have any frequency that is less than the frequency of the more frequent allele, including a frequency of less than 1% in a population. A SNP can, in some instances, be referred to as a "cSNP" to denote that the nucleotide sequence containing the SNP is an amino acid coding sequence.

A SNP may arise due to a substitution of one nucleotide for another at the polymorphic site. Substitutions can be transitions or transversions. A transition is the replacement of one purine nucleotide by another purine nucleotide, or one pyrimidine by another pyrimidine. A transversion is the replacement of a purine by a pyrimidine, or vice versa. A SNP may also be a single base insertion/deletion variant (referred to as "indels"). A substitution that changes a codon coding for one amino acid to a codon coding for a different amino acid is referred to as a non-synonymous codon change, or missense mutation. A synonymous codon change, or silent mutation, is one that does not result in a change of amino acid due to the degeneracy of the genetic code. A nonsense mutation is a type of non-synonymous codon change that results in the formation of a stop codon, thereby leading to premature termination of a polypeptide chain and a defective protein.

SNPs, in principle, can be bi-, tri-, or tetra- allelic. However, tri- and tetra-allelic polymorphisms are extremely rare, almost to the point of non-existence (Brookes, *Gene* 234 (1999) 177–186). For this reason, SNPs are often referred to as "bi-allelic markers", or "di-allelic markers".

Causative SNPs are those SNPs that produce alterations in gene expression or in the expression or function of a gene product, and therefore are most predictive of a possible clinical phenotype. One such class includes SNPs falling within regions of genes encoding a polypeptide product, i.e. cSNPs. These SNPs may result in an alteration of the amino acid sequence of the polypeptide product (i.e., non-synonymous codon changes) and give rise to the expression of a defective or other variant protein. Furthermore, in the case of nonsense mutations, a SNP may lead to premature termination of a polypeptide product. Such variant products can result in a pathological condition, e.g., genetic disease. Examples of genes in which a polymorphism within a coding sequence gives rise to genetic disease include sickle cell anemia and cystic fibrosis. Causative SNPs do not necessarily have to occur in coding regions; causative SNPs can occur in any region that can ultimately affect the expression and/or activity of the protein encoded by the nucleic acid. Such gene areas include those involved in transcription, such as SNPs in promoter regions, in gene areas involved in transcript processing, such as SNPs at intron-exon boundaries that may cause defective splicing, or SNPs in mRNA processing signal sequences such as polyadenylation signal regions. For example, a SNP may inhibit splicing of an intron and result in mRNA containing a premature stop codon, leading to a defective protein. Consequently, SNPs in regulatory regions can have substantial phenotypic impact.

Some SNPs that are not causative SNPs nevertheless are in close association with, and therefore segregate with, a disease-causing sequence. In this situation, the presence of the SNP correlates with the presence of, or susceptibility to, the disease. These SNPs are invaluable for diagnostics and disease susceptibility screening.

Clinical trials have shown that patient response to treatment with pharmaceuticals is often heterogeneous. Thus there is a need for improved approaches to pharmaceutical agent design and therapy. SNPs can be used to help identify patients most suited to therapy with particular pharmaceutical agents (this is often termed "pharmacogenomics"). Pharnacogenomics can also be used in pharmaceutical research to assist the drug selection process. (Linder et al. (1997), Clinical Chemistry, 43, 254; Marshall (1997), Nature Biotechnology, 15, 1249; International Patent Application WO 97/40462, Spectra Biomedical; and Schafer et al. (1998), Nature Biotechnology, 16, 3.).

Population Genetics

Population Genetics is the study of how Mendel's laws and other genetic principles apply to entire populations.

Such a study is essential to a proper understanding of the genetic basis of osteoporosis and SNP-based association studies and linkage disequilibrium mapping. Population genetics thus seeks to understand and to predict the effects of such genetic phenomena as segregation, recombination, and mutation; at the same time, population genetics must take into account such ecological and evolutionary factors as population size, patterns of mating, geographic distribution of individuals, migration and natural selection.

Linkage is the coinheritance of two or more nonallelic genes because their loci are in close proximity on the same chromosome, such that after meiosis they remain associated more often than the 50% expected for unlinked genes. During meiosis, there is a physical crossing over, it is clear that during the production of germ cells there is a physical exchange of maternal and paternal genetic contributions between individual chromatids. This exchange necessarily separates genes in chromosomal regions that were contiguous in each parent and, by mixing them with retained linear order, results in "recombinants". The process of forming recombinants through meiotic crossing-over is an essential feature in the reassortment of genetic traits and is central to understanding the transmission of genes.

Recombination generally occurs between large segments of DNA. This means that contiguous stretches of DNA and genes are likely to be moved together. Conversely, regions of the DNA that are far apart on a given chromosome are more likely to become separated during the process of crossing-over than regions of the DNA that are close together.

It is possible to use polymorphic molecular markers, such as SNPs, to clarify the recombination events that take place during meiosis. They are used as position markers and regional identifying characters along chromosomes and can also be used to distinguish paternally derived gene regions from maternally derived gene regions.

The pattern of a set of markers along a chromosome is referred to as a "Haplotype". Therefore sets of alleles on the same small chromosomal segment tend to be transmitted as a block through a pedigree. By analyzing the haplotypes in a series of offspring of parents whose haplotypes are known, it is possible to establish which parental segment of which chromosome was transmitted to which child. When not broken up by recombination, haplotypes can be treated for mapping purposes as alleles at a single highly polymorphic locus.

The existence of a preferential occurrence of a disease gene in association with specific alleles of linked markers, such as SNPs, is called "Linkage Disequilibrium"(LD). This sort of disequilibrium generally implies that most of the disease chromosomes carry the same mutation and the markers being tested are quite close to the disease gene. For example, there is considerable linkage disequilibrium across the entire HLA locus. The A3 allele is in LD with the B7 and B14 alleles, and as a result B7 and B14 are also highly associated with hemochromatosis. Thus, HLA typing alone can significantly alter the estimate of risk for hemochromatosis, even if other family members are not available for formal linkage analysis. Consequently, by using a combination of several markers surrounding the presumptive location of the gene, a haplotype can be determined for affected and unaffected family members.

SNP-Based Association Analysis and Linkage Disequilibrium Mapping

SNPs are useful in association studies for identifying particular SNPs, or other polymorphisms, associated with pathological conditions, such as osteoporosis. Association studies may be conducted within the general population and are not limited to studies performed on related individuals in affected families (linkage studies). An association study using SNPs involves determining the frequency of the SNP allele in many patients with the disorder of interest, such as osteoporosis, as well as controls of similar age and race. The appropriate selection of patients and controls is critical to the success of SNP association studies. Therefore, a pool of individuals with well-characterized phenotypes is extremely desirable. For example, blood pressure and heart rate can be correlated with SNP patterns in hypertensive individuals in whom these physiological parameters are known in order to find associations between particular SNP genotypes and known phenotypes. Significant associations between particular SNPs or SNP haplotypes and phenotypic characteristics can be determined by standard statistical methods. Association analysis can either be direct or LD based. In direct association analysis, causative SNPs are tested that are candidates for the pathogenic sequence itself.

In LD based SNP association analysis, random SNPs are tested over a large genomic region, possibly the entire genome, in order to find a SNP in LD with the true pathogenic sequence or pathogenic SNP. For this approach, high density SNP maps are required in order for random SNPs to be located close enough to an unknown pathogenic locus to be in linkage disequilibrium with that locus in order to detect an association. SNPs tend to occur with great frequency and are spaced uniformly throughout the genome. The frequency and uniformity of SNPs means that there is a greater probability, compared with other types of polymorphisms such as tandem repeat polymorphisms, that a SNP will be found in close proximity to a genetic locus of interest. SNPs are also mutationally more stable than tandem repeat polymorphisms, such as VNTRs. LD-based association studies are capable of finding a disease susceptibility gene without any a priori assumptions about what or where the gene is.

Currently, however, it is not feasible to do SNP association studies over the entire human genome, therefore candidate genes associated with osteoporosis are targeted for SNP identification and association analysis. The candidate gene approach uses a priori knowledge of disease pathogenesis to identify genes that are hypothesized to directly influence development of the disease. The candidate gene approach may focus on a gene that is directly targeted by a drug used to treat the disorder. To discover SNPs associated with an increased susceptibility to osteoporosis, candidate genes can be selected from systems physiologically implicated in the disease pathway. SNPs found in these genes are then tested for statistical association with disease in individuals who have the disease compared with appropriate controls. The candidate gene approach has the advantages of drastically reducing the number of candidate SNPs, and the number of individuals, that need to be typed, compared with LD-based association studies of random SNPs over large areas of, or complete, genomes. Furthermore, in the candidate gene approach, no assumptions are made about the extent of LD over any particular area of the genome.

Combined with the use of a high density map of appropriately spaced, sufficiently informative SNP markers, association studies, including linkage disequilibrium-based genome wide association studies, will enable the identification of most genes involved in complex disorders, such as osteoporosis. This will enhance the selection of candidate genes most likely to contain causative SNPs associated with a particular disease. All of the SNPs disclosed by the present invention can be employed as part of genome-wide association studies or as part of candidate gene association studies.

The present invention advances the state of the art and provides commercially useful embodiments by providing previously unidentified SNPs in genes known in the art to be associated with osteoporosis.

SUMMARY OF THE INVENTION

The present invention is based on the identification of novel SNPs and previously unknown haplotypes in genes known in the art to be associated with the pathologies of osteoporosis. Such polymorphisms/haplotypes can lead to a variety of pathologies and disorders associated with osteoporosis that are mediated/modulated by a variant gene/protein. Further, such polymorphisms are important reagents in studying the pathologies of osteoporosis.

Based on these identifications, the present invention provides methods of detecting these novel variants as well as reagents needed to accomplish this task. The invention specifically provides novel SNPs in genes known to be involved in osteoporosis, variant proteins encoded by the novel SNP forms of these genes, antibodies to the variant proteins, computer-based and data storage systems containing the novel SNP information, methods of detecting these SNPs in a sample, methods of determining a risk of having or developing a disorder mediated by a variant gene/protein, methods of screening for compounds used to treat disorders mediated by a variant gene/protein, methods of treating disorders mediated by a variant gene/protein, and methods of using the novel SNPs of the present invention for human identification. The present invention also provides genomic nucleotide sequences, transcript sequences, encoded amino acid sequences, and context sequences that contain the SNPs of the present invention.

DESCRIPTION OF THE FILES CONTAINED ON THE CD-R LABELED CL00789CDR

NOTE: Two duplicate copies of the CD-R are submitted herewith, labeled "Copy 1" and "Copy 2". The material on each of the duplicate CD-R's is identical. Thus, descriptions or references herein to the CD-R labeled CL00789CDR and the files contained thereon apply to both "Copy 1" and "Copy 2".

The CD-R labeled CL00789CDR contains the following two files:

1) File SEQLIST_789.txt provides the Sequence Listing of the transcript sequences (SEQ ID NOS:1–13), protein sequences (SEQ ID NOS:14–26), and genomic sequences (SEQ ID NOS:27–39) for each osteoporosis-associated gene that contains a SNP of the present invention. Also provided are the context sequences (SEQ ID NOS:40–848) that flank each SNP of the present invention. The context sequences generally provide about 300 bp upstream (5') and 300 bp downstream (3') of each SNP, with the SNP about in the middle of the sequence, for a total of about 600 bp of context sequence surrounding each SNP. The transcript, protein, genomic, and context sequences provided in the Sequence Listing are also provided in Table 1, where they are identified by their SEQ ID NO. The Sequence Listing is provided in text (ASCII) format. SEQLIST_789.txt is 2,308 KB in size and was created on Sep. 10, 2001.

2) File TABLE1_789.txt provides Table 1 in text (ASCII) format, which discloses the SNP and associated gene information of the present invention as indicated below in the "Detailed Description of Table 1", including the context sequences (SEQ ID NOS:40–848) flanking each SNP and the transcript (SEQ ID NOS:1–13), protein (SEQ ID NOS:14–26), and genomic sequences (SEQ ID NOS:27–39) of the osteoporosis-associated genes that contain each SNP. File TABLE1_789.txt is 1,910 KB in size and was created on Sep. 10, 2001.

The material contained on the CD-R labeled CL00789CDR is hereby incorporated by reference pursuant to 37 CFR 1.77(b)(4).

DESCRIPTION OF TABLE 1

Table 1 discloses the SNP and associated gene information of the present invention. For each SNP, Table 1 provides gene information followed by SNP information.

The gene information includes: a gene number, a Celera hCT number and/or a RefSeq NM number (the NM number is a reference number to an annotated human gene that is publicly known and whose role in disease processes is understood to the point of providing commercial uses for the naturally occurring variants herein described; the public gene identified by the NM number may be the same as the gene identified by the hCT number, or may be a homolog, or paralog thereof), the art-known gene name, the art-known protein name, Celera genomic axis position and chromosomal position/cytoband of the gene where available, a public reference (e.g., OMIM reference information, which can readily be used by one of ordinary skill in the art to associate the allelic variants of each gene provided herein with medically significant disease conditions and pathologies, thus providing readily apparent commercial utilities for the SNP information of the present invention) to the gene/protein name supporting the medical significance of the gene/protein, transcript sequence (corresponding to SEQ ID NOS:1–13 of the Sequence Listing), protein sequence (corresponding to SEQ ID NOS:14–26 of the Sequence Listing), and genomic sequence (corresponding to SEQ ID NOS:27–39 of the Sequence Listing) of the assembled genomic region containing the gene. The SEQ ID NOS provided for each sequence in Table 1 correspond with the SEQ ID NOS in the Sequence Listing, provided in file SEQLIST_789.TXT on the accompanying CD-R, label CL00789CDR. NOTE: the genomic sequences always correspond to Celera genomic sequences; where both a Celera hCT number and an NM number are provided for a gene, the transcript and protein sequences correspond to the Celera sequences identified by the hCT number, where only an NM number is provided for a gene, the transcript and protein sequences correspond to the public sequences identified for the NM number.

The SNP information includes: 300 bp of 5' and 3' context sequence (corresponding to SEQ ID NOS:40–848 of the Sequence Listing; in some instances, the context sequences may be reverse complemented relative to the gene/transcript sequences), Celera CV identification number for internal tracking, identified alleles, populations seen with alleles ("cau"=Caucasian, "his"=Hispanic, "chn"=Chinese, and "afr"=African, "jpn"=Japanese, "ind"=Indian, "mex"=Mexican, "ain"="American Indian, "cra"=Celera donor, "no_pop"=no population information available), SNP type ["MIS-SENSE MUTATION"=SNP causes a change in the encoded amino acid (i.e., a non-synonymous coding SNP); "INTERGENIC/UNKNOWN"=SNP occurs in an intergenic region of the genome; "UNKNOWN"=SNP is located in an uncharacterized genomic region; "SILENT MUTATION"= SNP does not cause a change in the encoded amino acid (i.e., a synonymous coding SNP); "STOP CODON MUTATION"=SNP is located in a stop codon; "NONSENSE MUTATION"=SNP creates a stop codon; "INTRON"=SNP is located in an intron, "UTR 5"=SNP is located in a 5' UTR of a transcript; "UTR 3"=SNP is located in a 3' UTR of a transcript; "PUTATIVE UTR 5"=SNP is located in a putative 5' UTR; "PUTATIVE UTR 3"=SNP is located in a putative 3' UTR; "DONOR SPLICE SITE"= SNP is located in a donor splice site (5' intron boundary); "ACCEPTOR SPLICE SITE"=SNP is located in an acceptor splice site (3' intron boundary); "REPEATS"=SNP is located in a repeat element; CODING REGION=generally, the SNP is an insertion/deletion ("indel") polymorphism that may cause a frameshift that alters the encoded protein downstream of the SNP; EXON=SNP is located in an exon; "HUMAN-MOUSE CONSERVED REGION"=SNP is located in a region of the human genome that shares a high degree of sequence similarity with the mouse; "CONSERVED SEGMENT PUTATIVE"=generally, SNP is located in a segment of the genome that is a putative regulatory region conserved between human and mouse; "CORE PROMOTER PREDICTION PUTATIVE"=SNP is located in a predicted core promoter; "TRANSCRIPTION FACTOR SITE PUTATIVE"=SNP is located in a predicted transcription factor binding site; "REGULATORY REGION"=SNP is located in a regulatory region; and "PUTATIVE REGULATORY REGION"=SNP is located in a putative regulatory region], affected protein (including Celera hCP or Genbank GI number, position of the amino acid residue within the protein identified by the hCP or GI number that is encoded by the codon containing the SNP, and alternative amino acids represented by 1-letter amino acid codes that are encoded by the alternative SNP alleles), and source [whether the SNP is found only in Celera data and is novel to the present invention ("Celera"), or at least one SNP allele has been found in a public database as well as in Celera data but the map position of the SNP may not be publicly known ("Celera+")].

DESCRIPTION OF THE FIGURE

FIG. 1 provides a diagrammatic representation of a discovery system containing the SNP information of the present invention in computer readable form.

DETAILED DESCRIPTION OF THE INVENTION

General Description

The shotgun sequencing method was used to sequence and assemble the human genome. During the sequencing phase, DNA samples from six individuals of various racial backgrounds (Caucasian, Hispanic, Chinese, and Negro) were sequenced to various extents and the sequence fragments were assembled to obtain an assembled consensus genomic sequence for human. Since DNA was sampled from six individuals, and each individual represents two sets of chromosomes, in addition to the consensus, genetic variation was found in the assemblies. These variations were subjected to rigorous analytical selection to lead to the identification of sequence variations that represent SNPs between the individuals whose DNA was sequenced.

The genomic assembly and identified sequence variation was then compared to publicly known genes involved in osteoporosis. Regions of the assemblies that represented the corresponding gene were selected and the variations are provided herein.

Based on this work, the present invention provides methods and reagents needed to detect the disclosed SNPs in genes known in the art to contribute to osteoporosis (See Background, Table 1, and the Sequence Listing). Such polymorphisms/haplotypes can lead to a variety of disorders that are mediated/modulated by a gene/protein, particularly susceptibility to osteoporosis and associated pathologies.

The present invention specifically provides genomic nucleotide sequences, cDNA sequences, amino acid sequences, and context/probes and primer sequences that contain SNPs in the genes provided in Table 1 and the Sequence Listing, methods of detecting these polymorphisms/haplotypes in a sample, methods of determining a risk of having or developing a disorder mediated by a variant gene/protein, methods of treating a disorder mediated by a SNP of the present invention, methods of screening for compounds used to treat disorders mediated by a variant gene/protein of the present invention, and methods of using the SNPs of the present invention for human identification.

Those in the art will readily recognize that nucleic acid molecules may be double stranded molecules and that reference to a particular site on one strand refers, as well, to the corresponding site on a complementary strand. Thus, in defining a polymorphic site, reference to an adenine, a thymine (uridine), a cytosine, or a guanine at a particular site on one strand of a nucleic acid molecule is also intended to include the thymine (uridine), adenine, guanine, or cytosine (respectively) at the corresponding site on a complementary strand of the nucleic acid molecule. Thus, reference may be made to either strand in order to refer to a particular SNP position. Oligonucleotide, such as probes and primers, may be designed to hybridize to either strand and SNP genotyping methods may generally target either strand. Throughout the text, in identifying a polymorphic site, reference is made to the protein encoding strand, only for the purpose of convenience.

References made throughout the text to SNP-containing nucleic acids, variant nucleic acids, or variant genes may include a SNP site alone, as well as one or more SNP sites in combination with neighboring context nucleic acid sequences that contain the SNP site(s). The nucleic acid sequence can be a nucleotide sequence comprising one or more SNPs of the present invention, or a complementary nucleotide sequence comprising a sequence complementary to one or more SNPs of the present invention.

References to either variant peptides/polypeptides, or variant proteins of the present invention includes peptides/polypeptides/proteins, or fragments thereof, that contain an amino acid that differs from the corresponding amino acid found in the "wild-type", "reference", "normal", or previously characterized peptide/polypeptide/protein due to a codon change resulting from a nonsynonymous nucleotide substitution at a SNP position disclosed by the present invention. Variant peptides/polypeptides/proteins of the present invention may also be due to a SNP disclosed by the present that generates a nonsense mutation that leads to a premature stop codon or a SNP that abolishes a stop codon, or due to any SNP disclosed by the present invention that alters the expression, structure, or function of a protein, for example, a SNP in a control element such as a promoter or enhancer or a SNP that leads to defective splicing.

REAGENTS FOR DETECTING SNP VARIANTS

In Table 1, the present invention provides the name of a known gene that has been shown to be involved in, or implicated in, osteoporosis, its chromosomal position, a citation or public reference identifier, the transcript and protein sequence of the encoded gene products, the consensus human genome assembly containing the known gene and the SNP information of the present invention.

The SNP information is provided as context 300 base pair sequences found 3' and 5' of the variant, the alleles present at the site, and additional information about the variant, such as the nature of the SNP (coding, missense, etc.), population it was found in, etc.

The SNP information provided herein can be provided as reagents needed for detecting the variant in the form of sequence probes and primers specific for the variant sequence or antibodies specific for the variant protein, as information in discovery systems for analyzing this and/or other variants in these important genes. These reagents can be used in methods for detecting the presence of these variants and discriminating them for the art known forms.

Isolated SNP-Containing Nucleic Acid Molecules

The present invention provides isolated nucleic acid molecules that contain one or more SNPs disclosed by the present invention. The present invention further provides isolated nucleic acid molecules that encode the variant protein. Such nucleic acid molecules will consist of, consist essentially of, or comprise one or more SNPs of the present invention. The nucleic acid molecule can have additional nucleic acid residues, such as nucleic acid residues that are naturally associated with it or heterologous nucleotide sequences.

As used herein, an "isolated" SNP-containing nucleic acid molecule is one that contains a SNP of the present invention and is separated from other nucleic acid present in the natural source of the nucleic acid. Generally, the isolated SNP-containing nucleic acid, as used herein, will be comprised of one or more SNP positions disclosed by the present invention with flanking nucleotide sequence on either side of the SNP positions. Preferably the flanking sequence is up to about 300 bases, 100 bases, 50 bases, 30 bases, 15 bases, 10 bases, or 4 bases on either side of a SNP position for detection reagents or as long as the entire protein encoding sequence if it is to be used to produce a protein containing the coding variants disclosed in Table 1 and the Sequence Listing. The important point is that the nucleic acid is isolated from remote and unimportant flanking sequences and is of appropriate length such that it can be subjected to the specific manipulations or uses described herein such as recombinant expression, preparation of probes and primers for the SNP position, and other uses specific to the SNP-containing nucleic acid sequences.

Moreover, an "isolated" nucleic acid molecule, such as a cDNA molecule containing a SNP of the present invention, can be substantially free of other cellular material, or culture medium when produced by recombinant techniques, or chemical precursors or other chemicals when chemically synthesized. However, the nucleic acid molecule can be fused to other coding or regulatory sequences and still be considered isolated. For example, recombinant DNA molecules contained in a vector are considered isolated. Further examples of isolated DNA molecules include recombinant DNA molecules maintained in heterologous host cells or purified (partially or substantially) DNA molecules in solution. Isolated RNA molecules include in vivo or in vitro RNA transcripts of the isolated SNP-containing DNA molecules of the present invention Isolated nucleic acid molecules according to the present invention further include such molecules produced synthetically.

Isolated SNP-containing nucleic acid molecules can be in the form of RNA, such as mRNA, or in the form DNA, including cDNA and genomic DNA obtained by cloning or produced by chemical synthetic techniques or by a combination thereof The nucleic acid, especially DNA, can be double-stranded or single-stranded. Single-stranded nucleic acid can be the coding strand (sense strand) or the non-coding strand (anti-sense strand).

The present invention further provides related nucleic acid molecules that hybridize under stringent conditions to the nucleic acid molecules disclosed herein. As used herein, the term "hybridizes under stringent conditions " is intended to describe conditions for hybridization and washing under which nucleotide sequences encoding a peptide at least 60–70% homologous to each other typically remain hybridized to each other. The conditions can be such that sequences at least about 60%, at least about 70%, or at least about 80%, or at least about 90% or more homologous to each other typically remain hybridized to each other. Such stringent conditions are known to those skilled in the art and can be found in *Current Protocols in Molecular Biology*, John Wiley & Sons, N.Y. (1989), 6.3.1–6.3.6. One example of stringent hybridization conditions are hybridization in 6×sodium chloride/sodium citrate (SSC) at about 45° C., followed by one or more washes in 0.2×SSC, 0.1% SDS at 50–65° C. Examples of moderate to low stringency hybridization conditions are well known in the art.

Variant Protein/Peptide Molecules

The present invention provides polymorphic, SNP-containing, nucleic acid sequences that encode variants of the osteoporosis associated gene product (protein) disclosed herein (See Table 1 and the Sequence Listing). These variant molecules/sequences will be referred to herein as the variants of the present invention, the variant proteins of the present invention, or variant peptides/polypeptides/proteins of the present invention.

The present invention provides isolated variant protein molecules that comprise, consist of or consist essentially of one or more variant amino acids encoded by a nonsynonymous nucleotide substitution at one or more of the SNP positions disclosed herein; also referred to as variant amino acids, peptides/polypeptides, or proteins encoded by SNPs disclosed herein.

Variant proteins include, but are not limited to deletions, additions and substitutions in the amino acid sequence of the protein caused by SNPs of the present invention. Table 1 provides the variant protein information of the present invention. For example, one class of substitutions is conserved amino acid substitutions. Such substitutions are those that substitute a given amino acid in a peptide for another amino acid of like characteristics. Typical conservative substitutions are replacements, one for another, among the aliphatic amino acids Ala, Val, Leu, and Ile; interchange of the hydroxyl residues Ser and Thr; exchange of the acidic residues Asp and Glu; substitution between the amide residues Asn and Gln; exchange of the basic residues Lys and Arg; and replacements among the aromatic residues Phe and Tyr. Guidance concerning which amino acid changes are likely to be phenotypically silent are found in Bowie et al., *Science* 247:1306–1310 (1990).

Variant proteins can be fully functional or can lack function in one or more activities, e.g. ability to bind substrate, ability to phosphorylate substrate, ability to mediate signaling, etc. Fully functional variants typically contain only conservative variation or variation in non-critical residues or in non-critical regions. Functional variants can also contain substitution of similar amino acids that result in no change or an insignificant change in function. Alternatively, such substitutions may positively or negatively affect function to some degree.

Non-functional variants typically contain one or more non-conservative amino acid substitutions, deletions, insertions, inversions, or truncation or a substitution, insertion, inversion, or deletion in a critical residue or critical region.

As used herein, a protein or peptide is said to be "isolated" or "purified" when it is substantially free of cellular material or free of chemical precursors or other chemicals. The variant peptides of the present invention can be purified to homogeneity or other degrees of purity. The level of purification will be based on the intended use. The critical feature is that the preparation allows for the desired function of the variant peptide, even if in the presence of considerable amounts of other components.

In some uses, "substantially free of cellular material" includes preparations of the variant peptide having less than about 30% (by dry weight) other proteins (i.e., contaminating protein), less than about 20% other proteins, less than about 10% other proteins, or less than about 5% other proteins. When the variant peptide is recombinantly produced, it can also be substantially free of culture medium, i.e., culture medium represents less than about 20% of the volume of the protein preparation.

The language "substantially free of chemical precursors or other chemicals" includes preparations of the variant peptide in which it is separated from chemical precursors or other chemicals that are involved in its synthesis. In one embodiment, the language "substantially free of chemical precursors or other chemicals" includes preparations of the variant protein having less than about 30% (by dry weight) chemical precursors or other chemicals, less than about 20% chemical precursors or other chemicals, less than about 10% chemical precursors or other chemicals, or less than about 5% chemical precursors or other chemicals.

The isolated variant proteins can be purified from cells that naturally express it, purified from cells that have been altered to express it (recombinant), or synthesized using known protein synthesis methods. For example, a nucleic acid molecule containing SNP(s) encoding the variant protein is cloned into an expression vector, the expression vector introduced into a host cell and the variant protein expressed in the host cell. The variant protein can then be isolated from the cells by an appropriate purification scheme using standard protein purification techniques. Many of these techniques are described in detail below.

Accordingly, the present invention provides variant proteins that consist of amino acid sequences that contain one or more of the amino acid polymorphisms encoded by a SNP provided in Table 1. A protein consists of an amino acid sequence when the amino acid sequence is the final amino acid sequence of the protein.

The present invention further provides variant proteins that consist essentially of amino acid sequences that contain one or more of the amino acid polymorphisms encoded by a SNP provided in Table 1. A protein consists essentially of an amino acid sequence when such an amino acid sequence is present with only a few additional amino acid residues in the final protein.

The present invention further provides variant proteins that are comprised of amino acid sequences that contain one or more of the amino acid polymorphisms encoded by a SNP provided in Table 1. A protein is comprised of an amino acid sequence when the amino acid sequence is at least part of the final amino acid sequence of the protein. In such a fashion, the protein can be only the variant peptide or have additional amino acid molecules, such as amino acid residues (contiguous encoded sequence) that are naturally associated with it or heterologous amino acid residues/peptide sequences. Such a protein can have a few additional amino acid residues or can comprise several hundred or more additional amino acids. A brief description of how various types of these proteins can be made/isolated is provided below.

The variant proteins of the present invention can be attached to heterologous sequences to form chimeric or fusion proteins. Such chimeric and fusion proteins comprise a variant protein operatively linked to a heterologous protein having an amino acid sequence not substantially homologous to the variant protein. "Operatively linked" indicates that the variant protein and the heterologous protein are fused in-frame. The heterologous protein can be fused to the N-terminus or C-terminus of the variant protein.

A chimeric or fusion protein can be produced by standard recombinant DNA techniques. For example, DNA fragments coding for the different protein sequences are ligated together in-frame in accordance with conventional techniques. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see Ausubel et al., *Current Protocols in Molecular Biology*, 1992). Moreover, many expression vectors are commercially available that already encode a fusion moiety (e.g., a GST protein). A variant protein-encoding nucleic acid can be cloned into such an expression vector such that the fusion moiety is linked in-frame to the variant protein.

Polypeptides often contain amino acids other than the 20 amino acids commonly referred to as the 20 naturally occurring amino acids. Further, many amino acids, including the terminal amino acids, may be modified by natural processes, such as processing and other post-translational modifications, or by chemical modification techniques well known in the art. Common modifications that occur naturally in polypeptides are described in basic texts, detailed monographs, and the research literature, and they are well known to those of skill in the art. Accordingly, the variant peptides of the present invention also encompass derivatives or analogs in which a substituted amino acid residue is not one encoded by the genetic code, in which a substituent group is included, in which the mature polypeptide is fused with another compound, such as a compound to increase the half-life of the polypeptide (for example, polyethylene glycol), or in which the additional amino acids are fused to the mature polypeptide, such as a leader or secretory sequence or a sequence for purification of the mature polypeptide or a pro-protein sequence.

Known modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent crosslinks, formation of cystine, formation of pyroglutamate, formnylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

The present invention further provides fragments of the variant proteins of the present invention, in addition to proteins and peptides that comprise and consist of such fragments, provided that such fragments contain one or more amino acid polymorphisms encoded by a nonsynonymous SNP substitution provided by the present invention. The fragments to which the invention pertains, however, are not to be construed as encompassing fragments that may be disclosed publicly prior to the present invention.

As used herein, a fragment comprises at least 8 or more contiguous amino acid residues from a variant protein, wherein at least one residue is a variant amino acid encoded by a nonsynonymous nucleotide substitution at a SNP position provided by the present invention. Such fragments can be chosen based on the ability to retain one or more of the biological activities of the variant protein or could be chosen for the ability to perform a function, e.g. act as an immunogen. Particularly important fragments are biologically active fragments. Such fragments will typically comprise a domain or motif of the variant proteins of the present invention, e.g., active site or ligand binding domain. Further, possible fragments include, but are not limited to, domain or motif containing fragments, soluble peptide fragments, and fragments containing immnunogenic structures. Predicted domains and functional sites are readily identifiable by computer programs well known and readily available to those of skill in the art (e.g., PROSITE analysis).

Antibodies

The invention also provides antibodies that selectively bind to the variant proteins of the present invention as well as fragments thereof. Such antibodies may be used to quantitatively or qualitatively detect the variant protein or variant peptide molecules of the present invention. As used herein, an antibody selectively binds a target variant protein when it binds the variant protein and does not significantly bind to non-variant proteins, i.e., the antibody does not bind to normal, wild-type, or previously disclosed proteins that do not contain a variant amino acid encoded by a nonsynonymous nucleotide substitution at a SNP position disclosed herein.

As used herein, an antibody is defined in terms consistent with that recognized within the art: they are multi-subunit proteins produced by a mammalian organism in response to an antigen challenge. The antibodies of the present invention include monoclonal antibodies and polyclonal antibodies, as well as fragments of such antibodies, including, but not limited to, Fab or F(ab')$_2$, and Fv fragments.

Many methods are known for generating and/or identifying antibodies to a given target peptide. Several such methods are described by Harlow, Antibodies, Cold Spring Harbor Press, (1989). In general, to generate antibodies, an isolated peptide is used as an immunogen and is administered to a mammalian organism, such as a rat, rabbit or mouse. Either the full-length protein, an antigenic peptide fragment, or a fusion protein can be used.

Monoclonal antibodies can be produced by hybridomas, which are immortalized cell lines capable of secreting a specific monoclonal antibody. The immortalized cell lines can be created in vitro by fusing two different cell types, usually lymphocytes, one of which is a tumor cell.

Antibodies are preferably prepared from regions or discrete fragments of the variant protein containing a variant amino acid. Antibodies can be prepared from any region of the variant peptide as described herein, provided that the region contains a variant amino acid encoded by a nonsynonymous nucleotide substitution at a SNP position disclosed by the present invention. However, preferred regions will include those involved in function/activity and/or protein/binding partner interaction. An antigenic fragment will typically comprise at least 10 contiguous amino acid residues; at least one of the amino acid residues is an amino acid encoded by a SNP of the present invention. The antigenic peptide can comprise, however, at least 12, 14, 20 or more amino acid residues, provided that at least one amino acid is encoded by a SNP of the present invention. Such fragments can be selected on a physical property, such as fragments corresponding to regions that are located on the surface of the protein, e.g., hydrophilic regions or can be selected based on sequence uniqueness, or based on the position of the variant amino acid residue(s) encoded by the SNPs provided by the present invention.

Detection of an antibody of the present invention can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^{3}$H.

Design of SNP-Containing Nucleic Acids Detection Methods

The SNP-containing nucleic acid molecules of the present invention are useful as probes, primers, chemical intermediates, and in biological assays for SNPs of the present invention. The probes/primers can correspond to one or more of the SNPs provided in Table 1 and the Sequence Listing or can correspond to a specific region 5' and/or 3' to a SNP position, particularly a region corresponding to the context sequences provided in the Sequence Listing (SEQ ID NOS:40–848). However, as discussed above, fragments are not to be construed as encompassing fragments that are not associated with SNPs of the present invention or those known in the art for SNP detection. The SNP-containing nucleic acid molecules and information provided herein are also useful for designing primers for PCR to amplify any given SNP of the present invention and to design any formatted SNP detection reagent/kits.

A probe/primer typically comprises substantially a purified oligonucleotide or oligonucleotide pair. The oligonucleotide typically comprises a region of nucleotide sequence that hybridizes under stringent conditions to at least about 12, 20, 25, 40, 50 or more consecutive nucleotides. Depending on the particular application, the consecutive nucleotides can either include the target SNP position, or be a specific region in close enough proximity 5' and/or 3' to the SNP position to carry out the desired assay.

Preferred primer and probe sequences can readily be determined using the sequences provided in the Sequence Listing, particularly the SNP context sequences (SEQ ID NOS:40–848). It will be apparent to one of skill in the art that such primers and probes are useful as diagnostic probes or amplification primers for genotyping SNPs of the present invention, and can be incorporated into a kit format.

For analyzing SNPs, it may be appropriate to use oligonucleotides specific to alternative SNP alleles (referred to as "allele-specific oligonucleotides", "allele-specific probes", or "allele-specific primers"). The design and use of allele-specific probes for analyzing polymorphisms is described by e.g., Saiki et al., Nature 324, 163–166 (1986); Dattagupta, EP 235,726, Saiki, WO 89/11548.

In a hybridization-based assay, allele-specific probes can be designed that hybridize to a segment of target DNA from one individual but do not hybridize to the corresponding segment from another individual due to the presence of different polymorphic forms in the respective segments from the two individuals. Hybridization conditions should be sufficiently stringent that there is a significant difference in hybridization intensity between alleles, and preferably an essentially binary response, whereby a probe hybridizes to only one of the alleles. Some probes are designed to hybridize to a segment of target DNA such that the polymorphic site aligns with a central position (e.g., in a 15-mer at the 7 position; in a 16-mer, at either the 8 or 9 position) of the probe. This design of probe achieves good discrimination in hybridization between different allelic forms.

Allele-specific probes are often used in pairs, the "pairs" may be identical except for a one nucleotide mismatch that represents the allelic variants at the SNP position. One member of a pair perfectly matches a reference form of a target sequence and the other member perfectly matches a variant form. In the case of an array, several pairs of probes can then be immobilized on the same support for simultaneous analysis of multiple polymorphisms within the same target sequence.

In one type of PCR-based assay, an allele-specific primer hybridizes to a site on target DNA overlapping the SNP position and only primes amplification of an allelic form to which the primer exhibits perfect complementarity. See Gibbs, Nucleic Acid Res. 17 2427–2448 (1989). This primer is used in conjunction with a second primer that hybridizes at a distal site. Amplification proceeds from the two-primers, resulting in a detectable product that indicates the particular allelic form is present. A control is usually performed with a second pair of primers, one of which shows a single base mismatch at the polymorphic site and the other of which exhibits perfect complementarity to a distal site. The single-base mismatch prevents amplification and no detectable product is formed. The method works best when the mismatch is included in the 3'-most position of the oligonucleotide aligned with the polymorphism because this position is most destabilizing to elongation from the primer (see, e.g., WO 93/22456). This PCR-based assay can be utilized as part of the TaqMan assay, described below.

SNP Detection Kits, Nucleic Acid Arrays, and Integrated Systems

The present invention further provides SNP detection reagents and kits, such as arrays/microarrays of nucleic acid molecules, or probe/primer sets, and other detection reagent sets, that are based on the SNPs provided in Table 1 and the Sequence Listing.

In one embodiment of the present invention, kits are provided which contain the necessary reagents to carry out one or more assays that detect one or more SNPs disclosed herein. The present invention also provides multicomponent integrated systems for analyzing the SNPs provided by the present invention.

SNP detection kits may contain one or more oligonucleotide probes, or pairs of probes, that hybridize at or near each SNP position. Multiple pairs of allele-specific oligonucleotides may be included in the kit to simultaneously assay large numbers of SNPs, at least one of which is one of the SNPs of the present invention. In some kits/detection reagents, such as arrays, the allele-specific oligonucleotides are provided immobilized to a substrate. For example, the same substrate can comprise allele-specific oligonucleotide probes for detecting at least 1; 10; 100; 1000; 10,000; 100,000 or substantially all of the polymorphisms shown in Table 1 and the Sequence Listing.

Specifically, the invention provides a compartmentalized kit to receive, in close confinement, one or more containers which comprises: (a) a first container comprising one of the nucleic acid probes, for example an allele-specific oligonucleotide, that can bind to a fragment of the human genome containing a SNP disclosed herein; and (b) one or more other containers comprising one or more of the following: wash reagents or reagents capable of detecting the presence of a bound probe. Containers may be interchangeably referred to as, for example, "compartments", "chambers", or "channels".

In detail, a compartmentalized kit includes any kit in which reagents are contained in separate containers. Such containers include small glass containers, plastic containers, strips of plastic, glass or paper, or arraying material such as silica. Such containers allow one to efficiently transfer reagents from one compartment to another compartment such that the samples and reagents are not cross-contaminated, and the agents or solutions of each container can be added in a quantitative fashion from one compartment to another. Such containers may include a container which will accept the test sample, a container which contains the SNP probe, containers which contain wash reagents (such as phosphate buffered saline, Tris-buffers, etc.), and containers which contain the reagents used to detect the bound probe. The kit can further comprise reagents for PCR or other enzymatic reactions, and instructions for using the kit. One skilled in the art will readily recognize that the previously unidentified SNPs of the present invention can be routinely identified using the sequence information disclosed herein and can be readily incorporated into one of the established kit formats which are well known in the art.

As used herein "Arrays" or "Microarrays" refers to an array of distinct polynucleotides or oligonucleotides synthesized on a substrate, such as paper, nylon or other type of membrane, filter, chip, glass slide, or any other suitable solid support. In one embodiment, the microarray is prepared and used according to the methods described in U.S. Pat. No. 5,837,832, Chee et al., PCT application WO95/11995 (Chee et al.), Lockhart, D. J. et al. (1996; Nat. Biotech. 14: 1675–1680) and Schena, M. et al. (1996; Proc. Natl. Acad. Sci. 93: 10614–10619), all of which are incorporated herein in their entirety by reference. In other embodiments, such arrays are produced by the methods described by Brown et al., U.S. Pat. No. 5,807,522. Arrays or microarrays are commonly referred to as "DNA chips". As used herein, arrays/microarrays may be interchangeably referred to as detection reagents or kits.

Any number of oligonucleotide probes, such as allele-specific oligonucleotides, may be implemented in an array, wherein each probe or pair of probes corresponds to a different SNP position. The oligonucleotides are synthesized at designated areas on a substrate using a light-directed chemical process. The substrate may be paper, nylon or other type of membrane, filter, chip, glass slide or any other suitable solid support.

Hybridization assays based on oligonucleotide arrays rely on the differences in hybridization stability of short oligonucleotides probes to perfectly matched and mismatched target sequence variants. Efficient access to polymorphism information is obtained through a basic structure comprising high-density arrays of oligonucleotide probes attached to a solid support (e.g., a chip) at selected positions. Each DNA chip can contain thousands to millions of individual synthetic DNA probes arranged in a grid-like pattern and miniaturized to the size of a dime, each corresponding to a particular SNP position or allelic variant. Preferably, probes are attached to a solid support in an ordered, addressable array.

The array/chip technology has already been applied with success in numerous cases. For example, the screening of mutations has been undertaken in the BRCA1 gene, in S. cerevisiae mutant strains, and in the protease gene of HIV-I virus (Hacia et al., 1996; Shoemaker et al., 1996; Kozal et al., 1996). Chips of various formats for use in detecting SNPs can be produced on a customized basis.

An array-based tiling strategy useful for detecting SNPs is described in EP 785280. Briefly, arrays may generally be "tiled" for a large number of specific polymorphisms. "Tiling" refers to the synthesis of a defined set of oligonucleotide probes that are made up of a sequence complementary to the target sequence of interest, as well as preselected variations of that sequence, e.g., substitution of one or more given positions with one or more members of the basis set of monomers, i.e. nucleotides. Tiling strategies are further described in PCT application No. WO 95/11995. In a particular aspect, arrays are tiled for a number of specific SNPs. In particular, the array is tiled to include a number of detection blocks, each detection block being specific for a specific SNP or a set of SNPs. For example, a detection block may be tiled to include a number of probes that span the sequence segment that includes a specific SNP. To ensure probes that are complementary to each allele, the probes are synthesized in pairs differing at the SNP position. In addition to the probes differing at the SNP position, monosubstituted probes are also generally tiled within the detection block. Such methods can readily be applied to the SNP information disclosed herein.

These monosubstituted probes have bases at and up to a certain number of bases in either direction from the polymorphism, substituted with the remaining nucleotides (selected from A, T, G, C and U). Typically the probes in a tiled detection block will include substitutions of the sequence positions up to and including those that are 5 bases away from the SNP. The monosubstituted probes provide internal controls for the tiled array, to distinguish actual hybridization from artefactual cross-hybridization. Upon completion of hybridization with the target sequence and washing of the array, the array is scanned to determine the position on the array to which the target sequence hybridizes. The hybridization data from the scanned array is then analyzed to identify which allele or alleles of the SNP are present in the sample. Hybridization and scanning may be carried out as described in PCT application No. WO 92/10092 and WO 95/11995 and U.S. Pat. No. 5,424,186.

Thus, in some embodiments, the chips may comprise an array of nucleic acid sequences of fragments of about 15 nucleotides in length. In further embodiments, the chip may comprise an array including at least one of the sequences selected from the group consisting of those disclosed in Table 1 and the Sequence Listing, and the sequences complementary thereto, or a fragment thereof, said fragment comprising at least about 8 consecutive nucleotides, preferably 10, 15, 20, more preferably 25, 30, 40, 47, or 50 consecutive nucleotides and containing a polymorphic base. In some embodiments the polymorphic base is within 5, 4, 3, 2, or 1 nucleotides from the center of the polynucleotide, more preferably at the center of said polynucleotide. In other embodiments, the chip may comprise an array containing any number of polynucleotides of the present invention.

An oligonucleotide may be synthesized on the surface of the substrate by using a chemical coupling procedure and an ink jet application apparatus, as described in PCT application WO95/251116 (Baldeschweiler et al.) which is incorporated herein in its entirety by reference. In another aspect, a "gridded" array analogous to a dot (or slot) blot may be used to arrange and link cDNA fragments or oligonucleotides to the surface of a substrate using a vacuum system, thermal, UV, mechanical or chemical bonding procedures. An array, such as those described above, may be produced by hand or by using available devices (slot blot or dot blot apparatus), materials (any suitable solid support), and machines (including robotic instruments), and may contain 8, 24, 96, 384, 1536, 6144 or more oligonucleotides, or any other number which lends itself to the efficient use of commercially available instrumentation.

Using such arrays, the present invention provides methods of identifying the SNPs of the present invention in a sample. Such methods comprise incubating a test sample with an array comprising one or more oligonucleotide probes corresponding to at least one SNP position of the present invention, and assaying for binding of a nucleic acid from the test sample with one or more of the oligonucleotide probes. Such assays will typically involve arrays comprising oligonucleotides probes corresponding to many SNP positions and/or allelic variants of those SNP positions, at least one of which is a SNP of the present invention.

Conditions for incubating a nucleic acid molecule with a test sample vary. Incubation conditions depend on the format employed in the assay, the detection methods employed, and the type and nature of the nucleic acid molecule used in the assay. One skilled in the art will recognize that any one of the commonly available hybridization, amplification or array assay formats can readily be adapted to employ the novel SNPs disclosed herein. Examples of such assays can be found in Chard, T, An Introduction to Radioimmunoassay and Related Techniques, Elsevier Science Publishers, Amsterdam, The Netherlands (1986); Bullock, G. R et al., Techniques in Immunocytochemistry, Academic Press, Orlando, Fla. Vol. 1 (1 982), Vol. 2 (1983), Vol. 3 (1985); Tijssen, P., Practice and Theory of Enzyme Immunoassays: Laboratory Techniques in Biochemistry and Molecular Biology, Elsevier Science Publishers, Amsterdam, The Netherlands (1985).

The test samples of the present invention include, but are not limited to, nucleic acid extracts, cells, and protein or membrane extracts from cells, which may be obtained from any bodily fluids (such as blood, urine, saliva, phlegm, gastric juices, etc.), cultured cells, biopsies, or other tissue preparations. The test sample used in the above-described methods will vary based on the assay format, nature of the detection method and the tissues, cells or extracts used as the sample to be assayed. Methods of preparing nucleic acid, protein, or cell extracts are well known in the art and can be readily be adapted in order to obtain a sample that is compatible with the system utilized.

Multicomponent integrated systems, such as microfluidic-based systems or "lab on a chip" systems, are an exemplary type of kit provided by the present invention for analyzing SNPs. Such systems miniaturize and compartmentalize processes such as PCR and capillary electrophoresis reactions in a single functional device. An example of such technique is disclosed in U.S. Pat. No. 5,589,136, which describes the integration of PCR amplification and capillary electrophoresis in chips.

Integrated systems can be envisaged mainly when microfluidic systems are used. These systems comprise a pattern of microchannels designed onto a glass, silicon, quartz, or plastic wafer included on a microchip. The movements of the samples are controlled by electric, electroosmotic or hydrostatic forces applied across different areas of the microchip to create functional microscopic valves and pumps with no moving parts. Varying the voltage controls the liquid flow at intersections between the micro-machined channels and changes the liquid flow rate for pumping across different sections of the microchip. In such a system, the containers/compartments of the kit may be embodied as chambers and/or channels of the microfluidic system.

For genotyping SNPs, the microfluidic system may integrate, for example, nucleic acid amplification, minisequencing primer extension, capillary electrophoresis, and a detection method such as laser induced fluorescence detection.

In a first step, the DNA samples are amplified, preferably by PCR. Then, the amplification products are subjected to automated minisequencing reactions using ddNTPs (specific fluorescence for each ddNTP) and the appropriate oligonucleotide minisequencing primers which hybridize just upstream of the targeted polymorphic base. Once the extension at the 3' end is completed, the primers are separated from the unincorporated fluorescent ddNTPs by capillary electrophoresis. The separation medium used in capillary electrophoresis can be, for example, polyacrylamide, polyethyleneglycol or dextran. The incorporated ddNTPs in the single nucleotide primer extension products are identified by laser-induced fluorescence detection. This microchip can be used to process at least 96 to 384 samples, or more, in parallel.

Vectors/Host Cells

The invention also provides vectors containing the SNP-containing nucleic acid molecules described herein. The term "vector" refers to a vehicle, preferably a nucleic acid molecule, that can transport the SNP-containing nucleic acid molecules. When the vector is a nucleic acid molecule, the SNP-containing nucleic acid molecules are covalently linked to the vector nucleic acid. With this aspect of the invention, the vector includes a plasmid, single or double stranded phage, a single or double stranded RNA or DNA viral vector, or artificial chromosome, such as a BAC, PAC, YAC, OR MAC.

A vector can be maintained in the host cell as an extrachromosomal element where it replicates and produces additional copies of the SNP-containing nucleic acid molecules. Alternatively, the vector may integrate into the host cell genome and produce additional copies of the SNP-containing nucleic acid molecules when the host cell replicates.

The invention provides vectors for the maintenance (cloning vectors) or vectors for expression (expression vectors) of the SNP-containing nucleic acid molecules. The vectors can function in procaryotic or eukaryotic cells or in both (shuttle vectors).

Expression vectors contain cis-acting regulatory regions that are operably linked in the vector to the SNP-containing nucleic acid molecules such that transcription of the SNP-containing nucleic acid molecules is allowed in a host cell. The SNP-containing nucleic acid molecules can be introduced into the host cell with a separate nucleic acid molecule capable of affecting transcription. Thus, the second nucleic acid molecule may provide a trans-acting factor interacting with the cis-regulatory control region to allow transcription of the SNP-containing nucleic acid molecules from the vector. Alternatively, a trans-acting factor may be supplied by the host cell. Finally, a trans-acting factor can be produced from the vector itself. It is understood, however, that in some embodiments, transcription and/or translation of the nucleic acid molecules can occur in a cell-free system.

The regulatory sequence to which the SNP-containing nucleic acid molecules described herein can be operably linked include promoters for directing mRNA transcription. These include, but are not limited to, the left promoter from bacteriophage λ, the lac, TRP, and TAC promoters from *E. coli*, the early and late promoters from SV40, the CMV immediate early promoter, the adenovirus early and late promoters, and retrovirus long-terminal repeats.

In addition to control regions that promote transcription, expression vectors may also include regions that modulate transcription, such as repressor binding sites and enhancers. Examples include the SV40 enhancer, the cytomegalovirus immediate early enhancer, polyoma enhancer, adenovirus enhancers, and retrovirus LTR enhancers.

In addition to containing sites for transcription initiation and control, expression vectors can also contain sequences necessary for transcription termination and, in the transcribed region a ribosome binding site for translation. Other regulatory control elements for expression include initiation and termination codons as well as polyadenylation signals. The person of ordinary skill in the art would be aware of the numerous regulatory sequences that are useful in expression vectors. Such regulatory sequences are described, for example, in Sambrook et al., Molecular Cloning: A Laboratory Manual. 2nd. ed., Cold Spring Harbor Laboratory Press, Cold Spring Harbor, N.Y., (1989).

A variety of expression vectors can be used to express a SNP-containing nucleic acid molecule. Such vectors include chromosomal, episomal, and virus-derived vectors, for example vectors derived from bacterial plasmids, from bacteriophage, from yeast episomes, from yeast chromosomal elements, including yeast artificial chromosomes, from viruses such as baculoviruses, papovaviruses such as SV40, Vaccinia viruses, adenoviruses, poxviruses, pseudorabies viruses, and retroviruses. Vectors may also be derived from combinations of these sources such as those derived from plasmid and bacteriophage genetic elements, eg. cosmids and phagemids. Appropriate cloning and expression vectors for prokaryotic and eukaryotic hosts are described in Sambrook et al., Molecular Cloning: A Laboratory Manual. 2nd. ed., Cold Spring Harbor Laboratory Press, Cold Spring Harbor, N.Y., (1989).

The regulatory sequence may provide constitutive expression in one or more host cells (i.e. tissue specific) or may provide for inducible expression in one or more cell types such as by temperature, nutrient additive, or exogenous factor such as a hormone or other ligand. A variety of vectors that provide constitutive and inducible expression in prokaryotic and eukaryotic hosts are well known to those of ordinary skill in the art.

The SNP-containing nucleic acid molecules can be inserted into the vector nucleic acid by well-known methodology. Generally, the DNA sequence containing the SNP position that will ultimately be expressed is joined to an expression vector by cleaving the DNA sequence and the expression vector with one or more restriction enzymes and then ligating the fragments together. Procedures for restriction enzyme digestion and ligation are well known to those of ordinary skill in the art.

The vector containing the appropriate nucleic acid molecule can be introduced into an appropriate host cell for propagation or expression using well-known techniques. Bacterial cells include, but are not limited to, E. coli, Streptomyces, and Salmonella typhimurium Eukaryotic cells include, but are not limited to, yeast, insect cells such as Drosophila, animal cells such as COS and CHO cells, and plant cells.

As described herein, it may be desirable to express the variant peptide as a fusion protein. Accordingly, the invention provides fusion vectors that allow for the production of the variant peptides. Fusion vectors can increase the expression of a recombinant protein, increase the solubility of the recombinant protein, and aid in the purification of the protein by acting, for example, as a ligand for affinity purification. A proteolytic cleavage site may be introduced at the junction of the fusion moiety so that the desired variant peptide can ultimately be separated from the fusion moiety. Proteolytic enzymes include, but are not limited to, factor Xa, thrombin, and enterokinase. Typical fusion expression vectors include pGEX (Smith et al., Gene 67:31–40 (1988)), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. Examples of suitable inducible non-fusion E. coli expression vectors include pTrc (Amann et al., Gene 69:301–315 (1988)) and pET 11d (Studier et al., Gene Expression Technology: Methods in Enzymology 185:60–89 (1990)).

Recombinant protein expression can be maximized in a host bacteria by providing a genetic background wherein the host cell has an impaired capacity to proteolytically cleave the recombinant protein. (Gottesman, S., Gene Expression Technology: Methods in Enzymology 185, Academic Press, San Diego, Calif. (1990) 119–128). Alternatively, the sequence of the SNP-containing nucleic acid molecule of interest can be altered to provide preferential codon usage for a specific host cell, for example E. coli. (Wada et al., Nucleic Acids Res. 20:2111–2118 (1992)).

The SNP-containing nucleic acid molecules can also be expressed by expression vectors that are operative in yeast. Examples of vectors for expression in yeast e.g., S. cerevisiae include pYepSec1 (Baldari, et al., EMBO J. 6:229–234 (1987)), pMFa (Kwan et al., Cell 30:933–943 (1982)), pJRY88 (Schultz et al., Gene 54:113–123 (1987)), and pYES2 (Invitrogen Corporation, San Diego, Calif.).

The SNP-containing nucleic acid molecules can also be expressed in insect cells using, for example, baculovirus expression vectors. Baculovirus vectors available for expression of proteins in cultured insect cells (e.g., Sf 9 cells) include the pAc series (Smith et al., Mol. Cell Biol. 3:2156–2165 (1983)) and the pVL series (Lucklow et al., Virology 170:31–39 (1989)).

In certain embodiments of the invention, the SNP-containing nucleic acid molecules described herein are expressed in mammalian cells using mammalian expression vectors. Examples of mammalian expression vectors include pCDM8 (Seed, B. Nature 329:840(1987)) and pMT2PC (Kaufman et al., EMBO J. 6:187–195 (1987)).

The expression vectors listed herein are provided by way of example only of the well-known vectors available to those of ordinary skill in the art that would be useful to express the SNP-containing nucleic acid molecules. The person of ordinary skill in the art would be aware of other vectors suitable for maintenance propagation or expression of the SNP-containing nucleic acid molecules described herein. These are found for example in Sambrook, J., Fritsh, E. F., and Maniatis, T. Molecular Cloning: A Laboratory Manual. 2nd, ed., Cold Spring Harbor Laboratory, Cold Spring Harbor Laboratory Press, Cold Spring Harbor, N.Y., 1989.

The invention also encompasses vectors in which the SNP-containing nucleic acid sequences described herein are cloned into the vector in reverse orientation, but operably linked to a regulatory sequence that permits transcription of antisense RNA. Thus, an antisense transcript can be produced to the SNP-containing nucleic acid molecule sequences described herein, including both coding and non-coding regions. Expression of this antisense RNA is subject to each of the parameters described above in relation to expression of the sense RNA (regulatory sequences, constitutive or inducible expression, tissue-specific expression).

The invention also relates to recombinant host cells containing the vectors described herein. Host cells therefore include prokaryotic cells, lower eukaryotic cells such as yeast, other eukaryotic cells such as insect cells, and higher eukaryotic cells such as mammalian cells.

The recombinant host cells are prepared by introducing the vector constructs described herein into the cells by techniques readily available to the person of ordinary skill in the art. These include, but are not limited to, calcium phosphate transfection, DEAE-dextran-mediated transfection, cationic lipid-mediated transfection, electroporation, transduction, infection, lipofection, and other techniques such as those found in Sambrook, et al. (Molecular Cloning: A Laboratory Manual. 2nd, ed., Cold Spring Harbor Laboratory, Cold Spring Harbor Laboratory Press, Cold Spring Harbor, N.Y., 1989).

Host cells can contain more than one vector. Thus, different SNP-containing nucleotide sequences can be introduced on different vectors of the same cell. Similarly, the SNP-containing nucleic acid molecules can be introduced either alone or with other nucleic acid molecules that are not related to the SNP-containing nucleic acid molecules such as those providing trans-acting factors for expression vectors. When more than one vector is introduced into a cell, the vectors can be introduced independently, co-introduced or joined to the nucleic acid molecule vector.

In the case of bacteriophage and viral vectors, these can be introduced into cells as packaged or encapsulated virus by standard procedures for infection and transduction. Viral vectors can be replication-competent or replication-defective. In the case in which viral replication is defective, replication will occur in host cells providing functions that complement the defects.

Vectors generally include selectable markers that enable the selection of the subpopulation of cells that contain the recombinant vector constructs. The marker can be contained in the same vector that contains the SNP-containing nucleic acid molecules described herein or may be on a separate vector. Markers include tetracycline or ampicillin-resistance genes for prokaryotic host cells and dihydrofolate reductase or neomycin resistance for eukaryotic host cells. However, any marker that provides selection for a phenotypic trait will be effective.

While the mature variant proteins can be produced in bacteria, yeast, mammalian cells, and other cells under the control of the appropriate regulatory sequences, cell-free transcription and translation systems can also be used to produce these variant proteins using RNA derived from the DNA constructs described herein.

It is also understood that, depending upon the host cell in which recombinant production of the variant peptides described herein occurs, the variant peptides can have various glycosylation patterns, depending upon the cell, or maybe non-glycosylated as when produced in bacteria. In addition, the variant peptides may include an initial modified methionine in some cases as a result of a host-mediated process.

USES OF SNP DETECTION REAGENTS

SNP Genotyping

The process of determining which nucleotide(s) is/are present at one or more of the SNP positions disclosed in Table 1 and the Sequence Listing is referred to by such terms as SNP genotyping, SNP haplotyping, SNP typing, SNP scoring, SNP assaying, SNP profiling, SNP identification, and SNP screening. The invention provides methods for detecting which nucleotide is present at the SNP positions provided by the present invention, such as for use in screening for or treating a osteoporosis condition, or susceptibility thereto, associated with the SNPs of the present invention, or in genome mapping.

After a SNP position has been identified in a specific DNA sequence (as shown in Table 1 and the Sequence Listing), DNA samples can be genotyped to determine which allele is present at that SNP position. The neighboring sequence can be used to design a SNP detection reagent/kit. Preferred SNP genotyping methods include, but are not limited to, TaqMan, oligonucleotide arrays, and mass spectrometry (Mass Spec). Further, various primer extension strategies are known in the art and can be utilized in combination with Mass Spec or other approaches.

The TaqMan assay, also known as the 5' nuclease PCR assay, provides a sensitive and rapid means of genotyping SNPs. The TaqMan assay detects the accumulation of a specific amplified product during PCR. The TaqMan assay utilizes an oligonucleotide probe labeled with a fluorescent reporter dye at the 5' end of the probe and a quencher dye at the 3' end of the probe. The proximity of the quencher to the reporter in the intact probe maintains a reduced fluorescence for the reporter. During the PCR reaction, the 5' nuclease activity of DNA polymerase cleaves the probe, thereby separating the reporter dye and the quencher dye and resulting in increased fluorescence of the reporter. Accumulation of PCR product is detected directly by monitoring the increase in fluorescence of the reporter dye. The 5' nuclease activity of DNA polymerase cleaves the probe between the reporter and the quencher only if the probe hybridizes to the target and is amplified during PCR. The probe is designed to straddle a target SNP position and hybridize to the nucleic acid molecule only if a particular SNP allele is present.

Preferred TaqMan primer and probe sequences can readily be determined using the nucleic acid information provided herein. A number of computer programs, such as Primer-Express, can be readily used to obtain optimal primer/probe sets. It will be apparent to one of skill in the art that the primers and probes based on the nucleic acid information provided herein are useful as diagnostic probes or amplification primers for screening for SNPs of the present invention, and can be incorporated into a kit format.

Another method used for SNP typing is based on mass spectrometry. Mass spectrometry ("mass spec") takes advantage of the unique mass of each of the four nucleotides of DNA. SNPs can be unambiguously genotyped by mass spectrometry by measuring the differences in the mass of nucleic acids having alternate SNP alleles. MALDI-TOF (Matrix Assisted Laser Desorption Ionization—Time of Flight) mass spectrometry technology is preferred for extremely precise determinations of molecular mass, such as SNPs. Numerous approaches to SNP analysis have been developed based on mass spectrometry. A preferred mass spectrometry based method of SNP analysis is mini-sequencing primer extension, which can also be utilized in combination with other approaches, such as traditional gel-based formats and microarrays.

The mini-sequencing primer extension reaction involves designing and annealing a primer to a template PCR amplicon downstream from a target SNP position. A mix of dideoxynucleotide triphosphates (ddNTPs) and/or deoxynucleotide triphosphates (dNTPSs) are added to a reaction mixture containing PCR template, primer, and DNA polymerase. Extension of the primer terminates at the first position in the PCR template where a nucleotide complementary to one of the ddNTPs in the mix occurs. The primer can be either immediately 3' or several nucleotides removed from the SNP position. If the primer is several nucleotides removed from the target SNP, the only limitation is that the template sequence between the 3' end of the primer and the SNP position can not contain a nucleotide of the same type as the one to be detected, or this will cause premature termination of the extension primer. Alternatively, if all four ddNTPs alone, with no dNTPs, are added to the reaction mixture, the primer will always be extended by only one nucleotide, corresponding to the target SNP position. In this instance, primers are designed to bind one nucleotide downstream from the SNP position. Extension by only one nucleotide is preferable, as it minimizes the overall mass of the extended primer, thereby increasing the resolution of mass differences between alternative SNP nucleotides. Furthermore, mass-tagged dideoxynucleoside triphosphates (ddNTPs) can be employed in the primer extension reactions in place of unmodified ddNTPs. This increases the mass difference between primers extended with these ddNTPs, thereby providing increased sensitivity and accuracy, and is particularly useful for typing heterozygous base positions. Mass-tagging also alleviates the need for intensive sample-preparation procedures and decreases the necessary resolving power of the mass spectrometer.

The extended primers are then purified and analyzed by MALDI-TOF mass spectrometry to determine the identity of the nucleotide present at the SNP position. In one method of analysis, the products from the primer extension reaction are combined with light absorbing crystals that form a matrix. The matrix is then hit with an energy source such as a laser to ionize and desorb the nucleic acid molecules into the gas-phase. The ionized molecules are then ejected into a flight tube and accelerated down the tube towards a detector. The time between the ionization event, such as a laser pulse, and collision of the molecule with the detector is the time of flight of that molecule. The time of flight is precisely correlated with the mass-to-charge ratio (m/z) of the ionized molecule. Ions with smaller mass-to-charge ratios travel down the tube faster than ions with larger m/z and therefore the lighter ions reach the detector before the heavier ions. The time-of-flight is then converted into a corresponding, and highly precise, m/z. In this manner, SNPs can be identified based on the slight differences in mass, and the corresponding time of flight differences, inherent in nucleic acid molecules having different nucleotides at a single base position.

SNPs can also be scored by direct DNA sequencing. A variety of automated sequencing procedures can be utilized when performing the diagnostic assays ((1995) *Biotechniques* 19:448), including sequencing by mass spectrometry (see, e.g., PCT International Publication No. WO 94/16101; Cohen et al., *Adv. Chromatogr.* 36:127–162 (1996); and Griffin et al., *Appl. Biochem. Biotechnol* 38:147–159 (1993)).

Further examples of methods that can be used to screen for the SNPs of the present invention include single-strand conformational polymorphism (SSCP), and denaturing gradient gel electrophoresis (DGGE) (Myers et al., *Nature* 313:495 (1985)). SSCP identifies base differences by alteration in electrophoretic migration of single stranded PCR products, as described in Orita et al., *Proc. Nat. Acad.* Single stranded PCR products can be generated by heating or otherwise denaturing double stranded PCR products. Single-stranded nucleic acids may refold or form secondary structures that are partially dependent on the base sequence. The different electrophoretic mobilities of single-stranded amplification products are related to base-sequence differences at SNP positions. DGGE differentiates SNP alleles based on the different sequence-dependent stabilities and melting properties inherent in polymorphic DNA and the corresponding differences in electrophoretic migration patterns in a denaturing gradient gel. (Erlich, ed., PCR Technology, Principles and Applications for DNA Amplification, (W. H. Freeman and Co, New York, 1992), Chapter 7).

Sequence-specific ribozymes (U.S. Pat. No. 5,498,531) can be used to score SNPs based on the development or loss of a ribozyme cleavage site. Perfectly matched sequences can be distinguished from mismatched sequences by nuclease cleavage digestion assays or by differences in melting temperature. If the SNP affects a restriction enzyme cleavage site, the SNP can be identified by alterations in restriction enzyme digestion patterns, and the corresponding changes in nucleic acid fragment lengths determined by gel electrophoresis In scoring SNPs, genomic DNA can be analyzed directly or can be amplified using PCR prior to analysis. RNA or cDNA can be used in the same way. In some uses, detection of the SNP involves the use of a probe/primer in a polymerase chain reaction (PCR) (see, e.g. U.S. Pat. Nos. 4,683,195 and 4,683,202) or ligase chain reaction (LCR) (see, e.g., Landegran et al., *Science* 241:1077–1080 (1988); Nakazawa et al., *PNAS* 91:360–364 (1994); and Abravaya et al., *Nucleic Acids Res.* 23:675–682 (1995); Barany, F., *Proc. Nat]. Acad. Sci.* (U.S.A.) 88, 189–193 (1991)). Southern and Northern blot analysis can also be utilized for nucleic acid analysis.

SNP genotyping can include the steps of collecting a sample of cells from a patient, isolating nucleic acid (e.g., genomic, mRNA or both) from the cells of the sample, contacting the nucleic acid sample with one or more primers which specifically hybridize to a region of the isolated nucleic acid containing a target SNP under conditions such that hybridization and amplification of the gene occurs, and determining the nucleotide present at the SNP position, or, in some instances, detecting the presence or absence of an amplification product.

SNP Genotyping and Association

Association, or correlation, of particular SNP genotypes with a particular phenotype is performed for a population of individuals who have been tested for the presence or absence of a phenotypic trait of interest and for SNP marker sets (e.g., one or more of the SNPs disclosed in Table 1 and the Sequence Listing). To perform such analysis, the presence or absence of a set of polymorphisms (i.e. a polymorphic set) is determined for a set of the individuals, some of whom exhibit a particular trait, and some of whom exhibit lack of the trait. The alleles of each polymorphism of the set are then reviewed to determine whether the presence or absence of a particular allele is associated with the trait of interest. Correlation can be performed by standard statistical methods such as a chi-squared test and statistically significant correlations between polymorphic form(s) and phenotypic characteristics are noted. For example, it might be found that the presence of allele Al at SNP position A correlates with heart disease. As a further example, it might be found that the combined presence of allele Al at SNP position A and allele B1 at SNP position B correlates with increased susceptibility to osteoporosis.

Such correlation can be exploited in several ways. For example, in the case of a strong correlation between a set of one or more polymorphic forms and a disease for which treatment is available, detection of the polymorphic form set in a patient may justify immediate administration of treatment, or at least the institution of regular monitoring of the patient. Detection of a polymorphic form correlated with serious disease in a couple contemplating a family may also be valuable to the couple in their reproductive decisions. For example, the female partner might elect to undergo in vitro fertilization to avoid the possibility of transmitting such a polymorphism from her husband to her offspring. In the case of a weaker, but still statistically significant correlation between a polymorphic set and human disease, immediate therapeutic intervention or monitoring may not be justified. Nevertheless, the patient can be motivated to begin simple life-style changes (e.g., diet, exercise) that can be accomplished at little cost to the patient but confer potential benefits in reducing the risk of conditions to which the patient may have increased susceptibility by virtue of variant alleles.

Uses of SNP Genotypes

After determining which alleles are present in an individual at one or more SNP positions, or which alleles are present at one or more SNP positions in many individuals of a population, this information can be used in a number of methods, as described below. Examples of such methods include disease susceptibility screening, disease diagnosis, individualizing drug therapy based on an individual's genotype ("pharmacogenomics"), developing drugs based on a greater understanding of SNPs associated with a disease, human identification applications such as forensics, and grouping SNPs into haplotype groups.

For example, the SNP information provided by the present invention, particularly the mapping of each SNP to a precise nucleotide position in the human genome, provides the basis for haplotyping projects. For example, the information provided herein enables the SNPs of the present invention to be readily genotyped in multiple individuals, who may optionally represent diverse racial/ethnic groups, in order to classify groups of SNPs that are generally inherited together into haplotypes. Such haplotypes can further be studied for correlations with diseases or other phenotypic effects. See, for example, Stephens et al. (*Science* 293, 489493, 20 Jul. 2001) for further information regarding SNP haplotypes.

Disease Susceptibility Screening/Diagnosis

The polymorphisms of the invention may contribute to the phenotype, for example, a disease condition such as osteoporosis, of an individual in different ways. Some polymorphisms occur within a protein coding sequence and contribute to phenotype by affecting protein structure. Other polymorphisms occur in noncoding regions but may exert phenotypic effects indirectly via influence on replication, transcription, and translation. A single polymorphism may affect more than one phenotypic trait. Likewise, a single phenotypic trait may be affected by polymorphisms in different genes.

The contribution or association of particular SNPs with disease phenotypes, such as osteoporosis, enables the SNPs of the present invention to be used to develop superior diagnostic tests capable of identifying individuals who express a detectable trait, such as osteoporosis, as the result of a specific genotype or individuals whose genotype places them at risk of developing a detectable trait at a subsequent time. As described herein, the diagnostics may be based on a single SNP or a group of SNPs. Combined detection of a plurality of SNPs (for example, 2, 5, 10, 20 or more of the SNPs provided in Table 1 and the Sequence Listing) typically increases the probability of an accurate diagnosis. For example, the presence of a single polymorphic form known to correlate with osteoporosis might indicate a probability of 20% that an individual has or is susceptible to osteoporosis, whereas detection of five polymorphic forms, each of which correlates with osteoporosis, might indicate a probability of 80% that an individual has or is susceptible to osteoporosis. To further increase the accuracy of diagnosis or susceptibility screening, analysis of the SNPs of the present invention can be combined with that of other polymorphisms or other risk factors of osteoporosis, such as family history, diet, or lifestyle factors.

It will of course be understood by practitioners skilled in the treatment or diagnosis of osteoporosis that the present invention does not intend to provide an absolute identification of individuals who could be at risk of developing a particular disease such as osteoporosis and disorders related to osteoporosis but rather to indicate a certain degree or likelihood of developing a disease. However, this information is extremely valuable as it can, in certain circumstances, be used to initiate preventive treatments or to allow an individual carrying a significant haplotype to foresee warning signs such as minor symptoms. In diseases in which attacks may be extremely violent and sometimes fatal if not treated on time, the knowledge of a potential predisposition, even if this predisposition is not absolute, might contribute in a very significant manner to treatment efficacy.

The diagnostic techniques of the present invention may employ a variety of methodologies to determine whether a test subject has a SNP pattern associated with an increased risk of developing a detectable trait or whether the individual suffers from a detectable trait as a result of a particular mutation, including methods which enable the analysis of individual chromosomes for haplotyping, such as family studies, single sperm DNA analysis or somatic hybrids. The trait analyzed using the present diagnostics may be any detectable trait, including pathologies and disorders related to osteoporosis.

Another aspect of the present invention relates to a method of determining whether an individual is at risk of developing a trait or whether an individual expresses a trait as a consequence of possessing a particular trait-causing allele. The present invention relates to a method of determining whether an individual is at risk of developing a plurality of traits or whether an individual expresses a plurality of traits as a result of possessing a particular trait causing allele. These methods involve obtaining a nucleic acid sample from the individual and determining whether the nucleic acid sample contains one or more alleles of one or more SNPs indicative of a risk of developing the trait or indicative that the individual expresses the trait as a result of possessing a particular trait-causing allele.

In another embodiment, the agents of the present invention are used to determine whether an individual has a SNP affecting the level (i.e., the concentration of mRNA or protein in a sample, etc.) or pattern (i.e., the kinetics of expression, rate of decomposition, stability profile, Km, Vmax, etc.) of gene expression (collectively, the "gene response" of a cell or bodily fluid) (for example, a SNP in a gene, or in a regulatory region(s) or other gene(s) that control or affect the expression of the gene). Such an analysis of gene expression can be conducted by screening for mRNA corresponding to the SNP-containing gene or variant peptides encoded thereby.

Therapies/Pharmacogenomics/Drug Development

The invention provides methods for assessing the pharmacogenomic susceptibility of a subject harboring a particular SNP, or SNP haplotype, of the present invention to a particular pharmaceutical compound, or to a class of such compounds. Pharmacogenomics deals with clinically significant hereditary variations, such as SNPs, in the response to drugs due to altered drug disposition and abnormal action in affected persons. See, e.g., Roses, *Nature* 405, 857–865 (2000); Gould Rothberg, *Nature Biotechnology* 19, 209–211 (2001); Eichelbaum, *Clin. Exp. Pharmacol. Physiol.* 23(10–11):983–985 (1996); and Linder, *Clin. Chem.* 43(2): 254–266 (1997). The clinical outcomes of these variations result in severe toxicity of therapeutic drugs in certain individuals or therapeutic failure of drugs in certain individuals as a result of individual variation in metabolism. Thus, the SNP genotype of an individual can determine the way a therapeutic compound acts on the body or the way the body metabolizes the compound. Further, the activity of drug metabolizing enzymes affects both the intensity and duration of drug action.

The discovery of SNPs in drug metabolizing enzymes, drug transporters, proteins for pharmaceutical agents, and other drug targets has explained why some patients do not obtain the expected drug effects, show an exaggerated drug effect, or experience serious toxicity from standard drug dosages. SNPs can be expressed in the phenotype of the extensive metabolizer and in the phenotype of the poor metabolizer. Accordingly, SNPs may lead to allelic protein variants of a protein in which one or more of the protein functions in one population is different from those in another population. The SNPs and corresponding variant peptides thus provide a target to ascertain a genetic predisposition that can affect treatment modality. Thus, in a ligand-based treatment, SNPs may give rise to amino terminal extracellular domains and/or other ligand-binding regions that are more or less active in ligand binding, and protein activation.

Accordingly, ligand dosage would necessarily be modified to maximize the therapeutic effect within a given population containing a SNP/haplotype. As an alternative to genotyping, specific variant peptides containing variant amino acids encoded by the SNPs could be identified. Thus, pharmacogenomic characterization of an individual permits the selection of effective compounds and effective dosages of such compounds for prophylactic or therapeutic treatment based on the individual's SNP genotype, thereby enhancing and optimizing the therapeutic effectiveness of the therapy. Furthermore, the production of recombinant cells and transgenic animals containing these SNPs/haplotypes allow effective clinical design of treatment compounds and dosage regimens. For example, transgenic animals can be produced that differ only in specific SNP alleles in a gene that is orthologous to a human disease susceptibility gene.

Pharmacogenomic uses of the SNPs of the present invention provide several significant advantages for patient care, particularly in treating osteoporosis. Pharmacogenomic characterization of an individual, based on an individual's SNP genotype, identifies those individuals unlikely to respond to treatment with a particular medication and thereby allows doctors to avoid prescribing the medication to those individuals. SNP genotyping of an individual thereby enables doctors to select the appropriate medication and dosage regimen that will be most effective based on an individual's SNP genotype. This increases doctor's confidence in prescribing medications and motivates patients to comply with their drug regimens. Furthermore, pharmacogenomics will identify patients predisposed to toxicity and adverse reactions to particular drugs or drug dosages. Adverse drug reactions lead to more than 100,000 avoidable deaths per year in the United States alone and therefore represent a significant cause of hospitalization and death, as well as a significant economic burden on the healthcare system (Pfost et. al., *Trends in Biotechnology*, August 2000.). Thus pharmacogenomics has the potential to both save lives and reduce costs substantially.

A subject suffering from a pathological condition, such as osteoporosis, ascribed to a SNP may be treated so as to correct the genetic defect. (See Kren et al., *Proc. Natl. Acad. Sci. USA* 96:10349–10354 (1999)). Such a subject is identified by any method that can detect the polymorphism in a sample drawn from the subject. Such a genetic defect may be permanently corrected by administering to such a subject a nucleic acid fragment incorporating a repair sequence that supplies the wild-type nucleotide at the position of the SNP. This site-specific repair sequence encompasses an RNA/DNA oligonucleotide which operates to promote endogenous repair of a subject's genomic DNA. The site-specific repair sequence is administered in an appropriate vehicle, such as a complex with polyethylenimine, encapsulated in anionic liposomes, a viral vector such as an adenovirus, or other pharmaceutical composition that promotes intracellular uptake of the administered nucleic acid. A genetic defect leading to an inborn pathology may then be overcome, as the chimeric oligonucleotides induces incorporation of the wild type sequence into the subject's genome. Upon incorporation, the wild type gene product is expressed, and the replacement is propagated, thereby engendering a permanent repair and therapeutic enhancement of the clinical condition of the subject.

In cases in which a cSNP leads to a variant protein that is ascribed to be the cause of, or a contributing factor to, a pathological condition, a method of treating such a condition includes administering to a subject experiencing the pathology the wild type cognate of the variant protein. Once administered in an effective dosing regimen, the wild type cognate provides complementation or remediation of the pathological condition.

The invention further provides a method for identifying a compound that can be used to treat a disorder associated with expression of a variant gene, such as osteoporosis. The method typically includes assaying the ability of the compound to modulate the activity and/or expression of the SNP-containing nucleic acid and thus identifying a compound that can be used to treat a disorder characterized by undesired activity or expression of the SNP-containing nucleic acid. The assays can be performed in cell-based and cell-free systems. Cell-based assays include cells naturally expressing the SNP-containing nucleic acid molecule or recombinant cells genetically engineered to express the SNP-containing nucleic acid sequences.

The assay for variant nucleic acid expression can involve direct assay of nucleic acid levels, such as mRNA levels, or on collateral compounds involved in the signal pathway. Further, the expression of genes that are up- or down regulated in response to the variant protein signal pathway can also be assayed. In this embodiment the regulatory regions of these genes can be operably linked to a reporter gene such as luciferase.

Thus, modulators of variant gene expression can be identified in a method wherein a cell is contacted with a candidate compound and the expression of mRNA determined. The level of expression of variant mRNA in the presence of the candidate compound is compared to the level of expression of variant mRNA in the absence of the candidate compound. The candidate compound can then be identified as a modulator of SNP-containing nucleic acid expression based on this comparison and be used, for example to treat a disorder characterized by expression of the SNP-containing nucleic acid, such as osteoporosis. When expression of mRNA is statistically significantly greater in the presence of the candidate compound than in its absence, the candidate compound is identified as a stimulator of nucleic acid expression. When nucleic acid expression is statistically significantly less in the presence of the candidate compound than in its absence, the candidate compound is identified as an inhibitor of nucleic acid expression.

The invention further provides methods of treatment, with the SNP as a target, using a compound identified through drug screening as a gene modulator to modulate variant nucleic acid expression. Modulation includes both up-regulation (i.e. activation or agonization) or down-regulation (suppression or antagonization) of nucleic acid expression. Alternatively, a modulator of variant nucleic acid expression can be a small molecule or drug identified using the screening assays described herein as long as the drug or small molecule modulates the expression of variant nucleic acid.

Expression of proteins, either wild type or variant, may be altered in individuals with a particular SNP allele in a control element, such as a promoter, that regulates expression. In this situation, methods of treatment and compounds are identified, as discussed herein, that regulate or overcome the variant control element, thereby generating normal, or healthy, expression levels of either the wild type or variant protein.

The SNP-containing nucleic acid molecules are useful for monitoring the effectiveness of modulating compounds on the expression or activity of the variant gene in clinical trials or in a treatment regimen. Thus, the gene expression pattern can serve as a barometer for the continuing effectiveness of treatment with the compound, particularly with compounds to which a patient can develop resistance. The gene expression pattern can also serve as a marker indicative of a physiological response of the affected cells to the compound. Accordingly, such monitoring would allow either increased administration of the compound or the administration of alternative compounds to which the patient has not become resistant. Similarly, if the level of nucleic acid expression falls below a desirable level, administration of the compound could be commensurately decreased.

According to another aspect of the present invention, there is provided a pharmaceutical pack comprising a drug and a set of instructions for administration of the drug to humans diagnostically tested for one or more SNPs provided by the present invention.

The SNPs of the present invention are useful for improving the process of drug development. Individuals can be selected for clinical trials based on their SNP genotype. Individuals with SNP genotypes that indicate that they are most likely to respond to the drug can be included in the trials and those individuals whose SNP genotypes indicate that they would not respond to the drug, or suffer adverse reactions, can be eliminated from the clinical trials. This not only improves the safety of clinical trials, but also will enhance the chances that the trial will demonstrate statistically significant efficacy. Furthermore, the SNPs of the present invention may help explain why certain, previously developed drugs performed poorly in clinical trials and may help identify a subset of the population that would benefit from a drug that had previously performed poorly in clinical trials, thereby "rescuing" previously developed drugs.

Human Identification

In addition to their value related to osteoporosis and associated pathologies, the SNPs provided by the present invention are also valuable as human identification markers for such applications as forensics and paternity testing. Genetic variations in the nucleic acid sequences between individuals can be used as genetic markers to identify individuals and to associate a biological sample with an individual. Determination of which nucleotides occupy a set of SNP positions in an individual identifies a set of SNP markers that distinguishes the individual. The more SNP positions that are analyzed, the lower the probability that the set of SNPs in one individual is the same as that in an unrelated individual. Preferably, if multiple sites are analyzed, the sites are unlinked. Thus, SNPs of the invention may be used in conjunction with polymorphisms in distal genomic regions.

SNPs have numerous advantages over other types of polymorphic markers, such as short tandem repeats (STRs), and therefore SNPs are the preferred markers for forensic and human identification applications. SNPs can be easily scored and are amenable to automation, making SNPs the markers of choice for large-scale forensic databases. SNPs are found in much greater abundance throughout the genome than repeat polymorphisms. Population frequencies of two polymorphic forms can usually be determined with greater accuracy than those of multiple polymorphic forms at multi-allelic loci. SNPs are mutationaly more stable than repeat polymorphisms. SNPs are not susceptible to artifacts such as stutter bands that can hinder analysis. Stutter bands are frequently encountered when analyzing repeat polymorphisms, and are particularly troublesome when analyzing samples such as crime scene samples that may contain mixtures of DNA from multiple sources. Another significant advantage of SNP markers over STR markers is the much shorter length of nucleic acid needed to score a SNP. For example, STR markers are generally several hundred base pairs in length. SNPs, on the other hand, comprise a single base pair, and generally a short conserved region on either side of the SNP position for primer and/or probe binding. This makes SNPs more amenable to typing in highly degraded or aged biological samples that are frequently encountered in forensic casework in which DNA may be fragmented into short pieces. SNPs also are not subject to microvariant and "off-ladder" alleles frequently encountered when analyzing STR loci. Microvariants are deletions or insertions within a repeat unit that change the size of the amplified DNA product so that the amplified product does not migrate at the same rate as reference alleles with normal sized repeat units. When separated by size, such as by electrophoresis on a polyacrylamide gel, microvariants do not align with a reference allelic ladder of standard sized repeat units, but rather migrate between the reference alleles. The reference allelic ladder is used for precise sizing of alleles for allele classification; therefore alleles that do not align with the reference allelic ladder lead to substantial analysis problems. Furthermore, when analyzing multi-allelic repeat polymorphisms, occasionally an allele is found that consists of more or less repeat units that has been previously seen in the population. These alleles will migrate outside the size range of known alleles in a reference allelic ladder, and therefore are referred to as "off-ladder" alleles. In extreme cases, the allele may contain so few or so many repeats that it migrates well out of the range of the reference allelic ladder. In this situation, the allele may not even be observed, or, with multiplex analysis, it may migrate within or close to the size range for another locus, further confounding analysis. SNP analysis avoids the problems of microvariants and off-ladder alleles encountered in STR analysis. Importantly, microvariants and off-ladder alleles may provide significant problems, and may be completely missed, when using analysis methods such as oligonucleotide hybridization arrays, which utilize oligonucleotide probes specific for certain known alleles. Furthermore, off-ladder alleles and microvariants encountered with STR analysis, even when correctly typed, may lead to improper statistical analysis, since their frequencies in the population are generally unknown or poorly characterized, thereby the statistical significance of a matching genotype may be questionable. All these advantages are considerable in light of the consequences of most DNA identification cases, which may lead to life imprisonment for an individual, or re-association of remains to the family of a deceased individual.

DNA can be isolated from biological samples such as blood, bone, hair, saliva, and semen and compared with the DNA from a reference source at particular SNP positions. Multiple SNP markers can be assayed simultaneously in order to increase the power of discrimination and the statistical significance of a matching genotype. For example, oligonucleotide arrays can be used to genotype a large number of SNPs simultaneously. The SNPs provided by the present invention can be assayed in combination with other polymorphic genetic markers, such as other SNPs or short tandem repeats (STRs), in order to identify an individual or to associate an individual with a particular biological sample.

Furthermore, the SNPs provided by the present invention can be typed for inclusion in a database of DNA genotypes, for example a criminal DNA databank. A genotype obtained from a biological sample of unknown source can then be queried against the database to find a matching genotype, with the SNPs of the present invention providing nucleotide positions at which to compare the known and unknown DNA sequences for identity.

SNPs of the present invention can also be assayed for use in paternity testing. The object of paternity testing is usually to determine whether a male is the father of a child. In most cases, the mother of the child is known and thus, the mother's contribution to the child's genotype can be traced. Paternity testing investigates whether the part of the child's genotype not attributable to the mother is consistent with that of the putative father. Paternity testing can be performed by analyzing sets of polymorphisms in the putative father and the child. If the set of polymorphisms in the child attributable to the father does not match the set of polymorphisms of the putative father, it can be concluded, barring experimental error, that the putative father is not the real father. If the set of polymorphisms in the child attributable to the father does match the set of polymorphisms of the putative father, a statistical calculation can be performed to determine the probability of coincidental match.

The uses of the SNPs of the present invention for human identification extends to various authentication systems, commonly referred to as biometric systems. Biometric systems convert physical characteristics of humans (or other organisms) into digital data for precise quantification. Biometric systems include various technological devices that measure such unique anatomical or physiological characteristics as finger, thumb, or palm prints; hand geometry; vein patterning on the back of the hand; blood vessel patterning of the retina and color and texture of the iris; facial characteristics; voice patterns; signature and typing dynamics; and DNA. Such physiological measurements can be used to verify identity and restrict or allow access based on the identification. Examples of applications for biometrics include physical area security, computer and network security, aircraft passenger check-in and boarding, financial trasactions, medical records access, government benefit distribution, voting, law enforcement, passports, visas and immigration, prisons, various military applications, and for restricting access to expensive or dangerous items, such as automobiles or guns. For a further review of biometric systems, see O'Connor, *Stanford Technology Law Review*. For an exemplary biometric system, see U.S. Pat. No. 6,119,096, Mann et al., which covers iris recognition for aircraft passenger check-in and boarding security. Large collections of SNPs, particularly the SNPs provided by the present invention, can be typed to uniquely identify an individual for biometric applications such as those described above. Such SNP typing can readily be accomplished using DNA chips as described above. Preferably, a minimally invasive means for obtaining a DNA sample is utilized. For example, PCR amplification enables sufficient DNA for analysis to be obtained from fingerprints, which contain DNA-containing skin cells and oils that are naturally transferred during contact Variant Protein/Peptide Uses The variant proteins of the present invention can be used in assays to determine the biological activity of the variant protein, including in a panel of multiple proteins for high-throughput screening; to raise antibodies or to elicit another immune response; as a reagent (including the labeled reagent) in assays designed to quantitatively determine levels of the variant protein (or its binding partner or protein) in biological fluids; and as markers for tissues in which the corresponding variant protein is preferentially expressed (either constitutively or at a particular stage of tissue differentiation or development or in a disease state). Any or all of these research utilities are capable of being developed into reagent grade or kit format for commercialization as research products. Methods for performing the uses listed above are well known to those skilled in the art. References disclosing such methods include "Molecular Cloning: A Laboratory Manual", 2d ed., Cold Spring Harbor Laboratory Press, Sambrook, J., E. F. Fritsch and T. Maniatis eds., 1989, and "Methods in Enzymology: Guide to Molecular Cloning Techniques", Academic Press, Berger, S. L. and A. R. Kimmel eds., 1987.

The variant proteins of the present invention provide a target for diagnosing a disease or predisposition to disease mediated by a variant osteoporosis associated gene/protein. Accordingly, the invention provides methods for detecting the presence, or levels of, the variants of the present invention (or encoding nucleic acid) in a cell, tissue, or organism. The method involves contacting a biological sample with a compound capable of interacting with the variant protein (or SNP-containing gene or mRNA encoding the variant protein) such that the interaction can be detected. The variant protein can be isolated from a biological sample and assayed for the presence of a variant amino acid encoded by a nucleic acid containing a SNP disclosed by the present invention that results in aberrant protein activity. SNPs and corresponding amino acid variations are provided in Table 1 and the Sequence Listing. The SNPs may result in changes to the protein and the corresponding protein activity, such as through non-synonymous substitutions in protein coding regions, formation of nonsense mutations, or by altering control elements such as promoters. Analytic methods of detecting amino acid variants include altered electrophoretic mobility, altered tryptic peptide digest, altered protein activity in cell-based or cell-free assay, alteration in ligand or antibody-binding pattern, altered isoelectric point, direct amino acid sequencing, and any other of the known assay techniques useful for detecting mutations in a protein.

One agent for detecting a variant protein in a sample is an antibody capable of selectively binding to a variant form of the protein. Such samples include tissues, cells, and biological fluids isolated from a subject, as well as tissues, cells and fluids present within a subject.

In vitro techniques for detection of the specific allelic variants of the osteoporosis associated protein, and fragments thereof, disclosed herein include enzyme linked immunosorbent assays (ELISAs), Western blots, inununoprecipitations and immnunofluorescence. Alternatively, the variant peptide can be detected in vivo in a subject by introducing into the subject a labeled antibody to the variant peptide. For example, the antibody can be labeled with a radioactive marker whose presence and location in a subject can be detected by standard imaging techniques.

The variant proteins of the present invention are also useful for biological assays. Such assays involve any of the known functions or activities or properties useful for the diagnosis and treatment of osteoporosis and associated conditions.

The variant proteins of the present invention are also useful in drug screening assays, in cell-based or cell-free systems. Cell-based systems can be native, i.e., cells that normally express the protein, as a biopsy or expanded in cell culture. In one embodiment, however, cell-based assays involve recombinant host cells expressing the variant protein. Cell-free assays can be used to detect the ability of a compound to directly bind to a variant protein or the corresponding SNP-containing nucleic acid fragment.

The variant proteins of the present invention can be used to identify compounds that modulate protein activity. Both the variant protein of the present invention and appropriate fragments can be used in high-throughput screens to assay candidate compounds for the ability to bind and/or modulate the activity of the variant protein. These compounds can be further screened against a functional, or a non-variant, protein to determine the effect of the compound on the protein activity. Further, these compounds can be tested in animal or invertebrate systems to determine activity/effectiveness. Compounds can be identified that activate (agonist) or inactivate (antagonist) the variant protein to a desired degree.

Further, the variant protein polypeptides can be used to screen a compound for the ability to stimulate or inhibit interaction between the variant protein and a target molecule that normally interacts with the protein. The target can be a ligand or a binding partner that the protein normally interacts with (for example, epinephrine or norepinephrine). Such assays typically include the steps of combining the variant protein with a candidate compound under conditions that allow the variant protein, or fragment, to interact with the target molecule, and to detect the formation of a complex between the protein and the target or to detect the biochemical consequence of the interaction with the variant protein and the target, such as any of the associated effects of signal transduction.

Candidate compounds include, for example, 1) peptides such as soluble peptides, including Ig-tailed fusion peptides and members of random peptide libraries (see, e.g., Lam et al., Nature 354:82–84 (1991); Houghten et al., Nature 354:84–86 (1991)) and combinatorial chemistry-derived molecular libraries made of D- and/or L-configuration amino acids; 2) phosphopeptides (e.g., members of random and partially degenerate, directed phosphopeptide libraries, see, e.g., Songyang et al, Cell 72:767–778 (1993)); 3) antibodies (e.g., polyclonal, monoclonal, humanized, anti-idiotypic, chimeric, and single chain antibodies as well as Fab, F(ab')2, Fab expression library fragments, and epitope-binding fragments of antibodies); and 4) small organic and inorganic molecules (e.g., molecules obtained from combinatorial and natural product libraries).

One candidate compound is a soluble fragment of the variant protein that competes for ligand binding. Other candidate compounds include mutant proteins or appropriate fragments containing mutations that affect variant protein function and thus compete for ligand. Accordingly, a fragment that competes for ligand, for example with a higher affinity, or a fragment that binds ligand but does not allow release, is encompassed by the invention.

The invention further includes other end point assays to identify compounds that modulate (stimulate or inhibit) variant protein activity. The assays typically involve an assay of events in the signal transduction pathway that indicate protein activity. Thus, the expression of genes that are up or down-regulated in response to the variant protein dependent signal cascade can be assayed. In one embodiment, the regulatory region of such genes can be operably linked to a marker that is easily detectable, such as luciferase. Alternatively, phosphorylation of the variant protein, or a variant protein target, could also be measured. Any of the biological or biochemical functions mediated by the variant protein can be used as an endpoint assay. These include all of the biochemical or biological events described herein, in the references cited herein, incorporated by reference for these endpoint assay targets, and other functions known to those of ordinary skill in the art.

The variant protein polypeptides are also useful in competition binding assays in methods designed to discover compounds that interact with the variant protein. Thus, a compound is exposed to a variant protein polypeptide under conditions that allow the compound to bind or to otherwise interact with the variant polypeptide. Ligands to the variant protein are also added to the mixture. If the test compound interacts with the variant protein or ligand, it decreases the amount of complex formed or activity from the variant protein target. This type of assay is particularly useful in cases in which compounds are sought that interact with specific regions of the variant protein See Hodgson, Bio/technology, 1992, Sep. 10(9), 973–80 for a review of competition binding assays and other receptor screening assays.

To perform cell free drug screening assays, it is sometimes desirable to immobilize either the variant protein, or fragment, or its target molecule to facilitate separation of complexes from uncomplexed forms of one or both of the proteins, as well as to accommodate automation of the assay.

Techniques for immobilizing variant proteins on matrices can be used in drug screening assays. In one embodiment, a fusion protein can be provided which adds a domain that allows the protein to be bound to a matrix. For example, glutathione-S-transferase/I125 fusion proteins can be adsorbed onto glutathione sepharose beads (Sigma Chemical, St. Louis, Mo.) or glutathione derivatized microtitre plates, which are then combined with the cell lysates (e.g., $^{35}$S-labeled) and a candidate compound, such as a drug candidate, and the mixture incubated under conditions conducive to complex formation (e.g., at physiological conditions for salt and pH). Following incubation, the beads are washed to remove any unbound label, and the matrix immobilized and radiolabel determined directly, or in the supenatant after the complexes are dissociated. Alternatively, the complexes can be dissociated from the matrix, separated by SDS-PAGE, and the level of protein-binding protein found in the bead fraction quantitated from the gel using standard electrophoretic techniques. For example, either the variant polypeptide or its target molecule can be immobilized utilizing conjugation of biotin and streptavidin using techniques well known in the art. Alternatively, antibodies reactive with the variant protein but which do not interfere with binding of the variant protein to its target molecule can be derivatized to the wells of the plate, and the variant protein trapped in the wells by antibody conjugation. Preparations of a protein-binding protein and a candidate compound are incubated in the variant protein-presenting wells and the amount of complex trapped in the well can be quantitated. Methods for detecting such complexes, in addition to those described above for the GST-immobilized complexes, include imnmunodetection of complexes using antibodies reactive with the protein target molecule, or which are reactive with variant protein and compete with the target molecule, as well as enzyme-linked assays that rely on detecting an enzymatic activity associated with the target molecule.

Agents that modulate the variant protein of the present invention can be identified using one or more of the above assays, alone or in combination. It is generally preferable to use a cell-based or cell free system first and then confirm activity in an animal or other model system. Such model systems are well known in the art and can readily be employed in this context.

Modulators of variant protein activity identified according to these drug screening assays can be used to treat a subject with a disorder mediated by the protein pathway, such as osteoporosis, by treating cells that express the variant protein. These methods of treatment include the steps of administering the modulators of protein activity in a pharmaceutical composition as described herein, to a subject in need of such treatment.

This invention further pertains to novel agents identified by the above-described screening assays. Accordingly, it is within the scope of this invention to further use an agent identified as described herein in an appropriate animal model. For example, an agent identified as described herein (e.g., a variant modulating agent, a variant antisense nucleic acid molecule, a variant osteoporosis associated protein-specific antibody, or a variant osteoporosis associated protein-binding partner) can be used in an animal model to determine the efficacy, toxicity, or side effects of treatment with such an agent. Alternatively, an agent identified as described herein can be used in an animal model to determine the mechanism of action of such an agent. Furthermore, this invention pertains to uses of novel agents identified by the above-described screening assays for treatments as described herein.

Antibody Uses

The antibodies can be used to isolate the variant proteins of the present invention by standard techniques, such as affinity chromatography or immunoprecipitation. The antibodies can facilitate the purification of the natural variant protein from cells and recombinantly produced variant protein expressed in host cells. In addition, such antibodies are useful for detecting the presence of the variant protein of the present invention in cells or tissues to determine the pattern of expression of the variant protein among various tissues in an organism and over the course of normal development or disease progression. Further, such antibodies can be used to detect variant protein in situ, in vitro, or in a cell lysate or supernatant in order to evaluate the abundance and pattern of expression. Also, such antibodies can be used to assess abnormal tissue distribution, abnormal expression during development, or expression in an abnormal condition, such as osteoporosis. Antibody detection of circulating fragments of the full length variant protein can be used to identify turnover.

Antibodies to the variant proteins of the present invention are useful in pharmacogenomic analysis. Thus, antibodies prepared against variant proteins encoded by the SNPs of the present invention can be used to identify individuals that require modified treatment modalities.

Further, the antibodies can be used to assess expression of the variant protein in disease states such as in active stages of the disease or in an individual with a predisposition toward disease related to the protein's function, particularly osteoporosis. Antibodies specific for a variant protein, encoded by a SNP of the present invention, can be used to assay for the presence of the variant protein, such as to screen for susceptibility to a disease associated with the presence of the variant protein, such as osteoporosis.

The antibodies are also useful as an immunological marker for variant protein analyzed by electrophoretic mobility, isoelectric point, tryptic peptide digest, and other physical assays known to those in the art.

The antibodies can also be used to assess aberrant subcellular localization of the variant protein in cells in various tissues. The diagnostic uses can be applied, not only in genetic testing, but also in monitoring a treatment modality. Accordingly, where treatment is ultimately aimed at correcting the expression level or the presence of variant protein or aberrant tissue distribution or developmental expression of the variant protein, antibodies directed against the variant protein or relevant fragments can be used to monitor therapeutic efficacy.

The antibodies are also useful for inhibiting variant protein function, for example, blocking the binding of the variant protein to a binding partner such as epinephrine or norepinephrine. These uses can also be applied in a therapeutic context in which treatment involves inhibiting the variant protein's function. An antibody can be used, for example, to block binding, thus modulating (agonizing or antagonizing) the variant peptides activity. Antibodies can be prepared against specific fragments containing sites required for function or against intact variant protein that is associated with a cell or cell membrane.

The invention also encompasses kits for using antibodies to detect the presence of a variant protein in a biological sample. The kit can comprise antibodies such as a labeled or labelable antibody and a compound or agent for detecting variant protein in a biological sample; means for determining the amount of variant protein in the sample; means for comparing the amount of variant protein in the sample with a standard; and instructions for use.

Uses of Vectors and Host Cells

The recombinant host cells expressing the variant peptides described herein have a variety of uses. First, the cells are useful for producing a variant protein or peptide that can be further purified to produce desired amounts of variant protein or fragments. Thus, host cells containing expression vectors are useful for variant peptide production.

Host cells are also useful for conducting cell-based assays involving the variant protein or variant protein fragments, such as those described above as well as other formats known in the art. Thus, a recombinant host cell expressing a variant protein is useful for assaying compounds that stimulate or inhibit variant protein function which may not be apparent by their effect on the native variant protein. Recombinant host cells are also useful for assaying functional alterations in the variant proteins compared with normal function.

Genetically engineered host cells can be further used to produce non-human transgenic animals. A transgenic animal is preferably a mammal, for example a rodent, such as a rat or mouse, in which one or more of the cells of the animal include a transgene. A transgene is exogenous DNA containing a SNP of the present invention which is integrated into the genome of a cell from which a transgenic animal develops and which remains in the genome of the mature animal in one or more cell types or tissues of the transgenic animal. These animals are useful for studying the function of a variant protein and identifying and evaluating modulators of variant protein activity. Other examples of transgenic animals include non-human primates, sheep, dogs, cows, goats, chickens, and amphibians.

A transgenic animal can be produced by introducing SNP-containing nucleic acid into the male pronuclei of a fertilized oocyte, e.g., by microinjection, retroviral infection, and allowing the oocyte to develop in a pseudopregnant female foster animal. Any protein nucleotide sequences that contain a SNP of the present invention can be introduced as a transgene into the genome of a non-human animal, such as a mouse.

Any of the regulatory or other sequences useful in expression vectors can form part of the transgenic sequence. This includes intronic sequences and polyadenylation signals, if not already included. A tissue-specific regulatory sequence(s) can be operably linked to the transgene to direct expression of the variant protein to particular cells.

Methods for generating transgenic animals via embryo manipulation and microinjection, particularly animals such as mice, have become conventional in the art and are described, for example, in U.S. Pat. Nos. 4,736,866 and 4,870,009, both by Leder et al., U.S. Pat. No. 4,873,191 by Wagner et al. and in Hogan, B., Manipulating the Mouse Embryo, (Cold Spring Harbor Laboratory Press, Cold Spring Harbor, N.Y., 1986). Similar methods are used for production of other transgenic animals. A transgenic founder animal can be identified based upon the presence of the transgene in its genome and/or expression of transgenic mRNA in tissues or cells of the animals. A transgenic founder animal can then be used to breed additional animals carrying the transgene. Moreover, transgenic animals carrying a transgene can further be bred to other transgenic animals carrying other transgenes. A transgenic animal also includes animals in which the entire animal or tissues in the animal have been produced using the homologously recombinant host cells described herein.

In another embodiment, transgenic non-human animals can be produced which contain selected systems that allow for regulated expression of the transgene. One example of such a system is the cre/loxP recombinase system of bacteriophage P1. For a description of the cre/loxP recombinase system, see, e.g., Lakso et al. PNAS 89:6232–6236 (1992). Another example of a recombinase system is the FLP recombinase system of S. cerevisiae (O'Gorman et al. Science 251:1351–1355 (1991). If a cre/loxP recombinase system is used to regulate expression of the transgene, animals containing transgenes encoding both the Cre recombinase and a selected protein is required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut, I. et al. Nature 385:810813 (1997) and PCT International Publication Nos. WO 97/07668 and WO 97107669. In brief, a cell, e.g., a somatic cell, from the transgenic animal can be isolated and induced to exit the growth cycle and enter $G_o$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyst and then transferred to pseudopregnant female foster animal. The offspring born of this female foster animal will be a clone of the animal from which the cell, e.g., the somatic cell, is isolated.

Transgenic animals containing recombinant cells that express the variant peptides described herein are useful to conduct the assays described herein in an in vivo context. Accordingly, the various physiological factors that are present in vivo and that could effect ligand binding, variant protein activation, and signal transduction, may not be evident from in vitro cell-free or cell-based assays. Accordingly, it is useful to provide non-human transgenic animals to assay in vivo variant protein function, including ligand interaction, and the effect of chimeric variant protein.

It is also possible to assess the effect of null mutations, that is mutations that substantially or completely eliminate one or more variant protein functions.

Computer Related Embodiments

The SNPs provided in the present invention may be "provided" in a variety of mediums to facilitate use thereof. As used herein, "provided" refers to a manufacture, other than an isolated nucleic acid molecule, that contains a SNP of the present invention. Such a manufacture provides the SNPs in a form that allows a skilled artisan to examine the manufacture using means not directly applicable to examining the SNPs or a subset thereof as they exists in nature or in purified form.

In one application of this embodiment, the SNPs of the present invention can be recorded on computer readable media. As used herein, "computer readable media" refers to any medium that can be read and accessed directly by a computer. Such media include, but are not limited to: magnetic storage media, such as floppy discs, hard disc storage medium, and magnetic tape; optical storage media such as CD-ROM; electrical storage media such as RAM and ROM; and hybrids of these categories such as magnetic/optical storage media. A skilled artisan can readily appreciate how any of the presently known computer readable media can be used to create a manufacture comprising computer readable medium having recorded thereon a nucleotide sequence of the present invention. One such medium is provided with the present application, namely, the present application contains computer readable medium (CD-R) that has the sequence fragments containing SNPs provided/recorded thereon in ASCII text format in a Sequence Listing.

As used herein, "recorded" refers to a process for storing information on computer readable medium. A skilled artisan can readily adopt any of the presently known methods for recording information on computer readable medium to generate manufactures comprising the SNP information of the present invention.

A variety of data storage structures are available to a skilled artisan for creating a computer readable medium having recorded thereon a nucleotide or amino acid sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as OB2, Sybase, Oracle, or the like. A skilled artisan can readily adapt any number of data processor structuring formats (e.g. text file or database) in order to obtain computer readable medium having recorded thereon the SNP information of the present invention.

By providing the SNPs of the present invention in computer readable form, a skilled artisan can routinely access the SNP information for a variety of purposes. Computer software is publicly available which allows a skilled artisan to access sequence information provided in a computer readable medium. Examples of publicly available computer software include BLAST (Altschul et at, *J. Mol. Biol.* 215:403410 (1990)) and BLAZE (Brutlag et at, *Comp. Chem.* 17:203–207 (1993)) search algorithms.

The present invention further provides systems, particularly computer-based systems, which contain the SNP information described herein. Such systems may be designed to store and/or analyze information on a large number of SNP positions, or information on SNP genotypes from a large number of individuals. The SNP information of the present invention represents a valuable information source. The SNP information of the present invention stored/analyzed in a computer-based system may be used for such computer-intensive applications as determining SNP allele frequencies in a population, for mapping disease genes, for genotype-phenotype association studies, for correlating SNP haplotypes with response to particular drugs, or for various other bioinformatic, pharmacogenomic, or forensic applications.

As used herein, "a computer-based system" refers to the hardware means, software means, and data storage means used to analyze the SNP information of the present invention. The minimum hardware means of the computer-based systems of the present invention comprises a central processing unit (CPU), input means, output means, and data storage means. A skilled artisan can readily appreciate that any one of the currently available computer-based systems are suitable for use in the present invention. Such a system can be changed into a system of the present invention by utilizing the SNP information provided on the CD-R, or a subset thereof without any experimentation.

As stated above, the computer-based systems of the present invention comprise a data storage means having stored therein SNPs of the present invention and the necessary hardware means and software means for supporting and implementing a search means. As used herein, "data storage means" refers to memory which can store SNP information of the present invention, or a memory access means which can access manufactures having recorded thereon the SNP information of the present invention.

As used herein, "search means" refers to one or more programs that are implemented on the computer-based system to score SNPs in a target sequence based on the SNP information stored within the data storage means. Search means are used to determine which nucleotide is present at a particular SNP position in the target sequence.

As used herein, a "target sequence" can be any DNA sequence containing the SNP position(s) to be scored.

As used herein, "a target structural motif," or "target motif," refers to any rationally selected sequence or combination of sequences containing the SNP position in which the sequence(s) is chosen based on a three-dimensional configuration which is formed upon the folding of the target motif. There are a variety of target motifs known in the art. Protein target motifs include, but are not limited to, enzymatic active sites and signal sequences. Nucleic acid target motifs include, but are not limited to, promoter sequences, hairpin structures, and inducible expression elements (protein binding sequences).

A variety of structural formats for the input and output means can be used to input and output the information in the computer-based systems of the present invention. A preferred format for an output means is presence or absence of specified nucleotides at particular polymorphic positions. Such presentation can provide a rapid scoring system for many SNPs simultaneously.

One application of this embodiment is provided in FIG. 1. FIG. 1 provides a block diagram of a computer system 102 that can be used to implement the present invention. The computer system 102 includes a processor 106 connected to a bus 104. Also connected to the bus 104 are a main memory 108 (preferably implemented as random access memory, RAM) and a variety of secondary storage devices 110, such as a hard drive 112 and a removable medium storage device 114. The removable medium storage device 114 may represent, for example, a floppy disk drive, a CD-ROM drive, a magnetic tape drive, etc. A removable storage medium 116 (such as a floppy disk, a compact disk, a magnetic tape, etc.) containing control logic and/or data recorded therein may be inserted into the removable medium storage device 114. The computer system 102 includes appropriate software for reading the control logic and/or the data from the removable storage medium 116 once inserted in the removable medium storage device 114.

The SNP information of the present invention may be stored in a well-known manner in the main memory 108, any of the secondary storage devices 110, and/or a removable storage medium 116. Software for accessing and processing the SNP information (such as SNP scoring tools, search tools, comparing tools, etc.) preferably resides in main memory 108 during execution.

All publications and patents mentioned in the above specification are herein incorporated by reference. Various modifications and variations of the described method and system of the invention will be apparent to those skilled in the art without departing from the scope and spirit of the invention. Although the invention has been described in connection with specific preferred embodiments, it should be understood that the invention as claimed should not be unduly limited to such specific embodiments. Indeed, various modifications of the above-described modes for carrying out the invention which are obvious to those skilled in the field of molecular biology or related fields are intended to be within the scope of the following claims.

SEQUENCE LISTING (848 sequences)

SEQ ID NO: 1 - DNA, 3597 bp, Human
ggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctc

SEQ ID NO: 2 - DNA, 3198 bp, Human
atgctgccacaaataccctttttgctgctagtatccttgaacttggttcatggagtgttttacgctgaacgataccaaacgcccacaggcataaaaggcccactacccaacaccaagacacagttcttcattccctacaccataaagagtaaaggtatagcagtaagaggagagcaaggtactcctggtccaccaggccctgctggacctcgagggcacccaggtccttctggaccaccaggaaaaccaggctacggaagtcctggactccaaggagagccagggttgccaggaccaccgggaccatcagctgtagggaaaccaggtgtgccaggactcccaggaaaaccaggagagagaggaccatatggaccaaaaggagatgttggaccagctggcctaccaggaccccggggcccaccaggaccacctggaatccctggaccggctggaatttctgtgccaggaaaacctggacaacagggacccacaggagccccaggacccaggggctttcctggagaaaagggtgcaccaggagtccctggtatgaatggacagaaaggggaaatgggatatggtgctcctggtcgtccaggtgagaggggtcttccaggccctcagggtcccacaggaccatctggccctcctggagtgggaaaaagaggtgaaaatggggttccaggacagccaggcatcaaaggtgatagaggttttccgggagaaatgggaccaattggcccaccaggtccccaaggccctcctggggaacgagggccagaaggcattggaaagccaggagctgctggagccccaggccagccagggattccaggaacaaaaggtctccctggggctccaggaatagctgggcccccagggcctcctggctttgggaaaccaggcttgccaggcctgaagggagaaagaggacctgctggccttcctgggggtccaggtgccaaaggggaacaagggccagcaggtcttcctgggaagccaggtctgactggaccccctgggaatatgggaccccaaggaccaaaaggcatcccgggtagccatggtctcccaggccctaaaggtgagacagggccagctgggcctgcaggataccctggggctaagggtgaaaggggttcccctgggtcagatggaaaaccagggtacccaggaaaaccaggtctcgatggtcctaagggtaacccagggttaccaggtccaaaaggtgatcctggagttggaggacctcctggtctcccaggccctgtgggcccagcaggagcaaagggaatgcccggacacaatggagaggctggcccaagaggtgcccctggaataccaggtactagaggccctattgggccaccaggcattccaggattccctgggtctaaaggggatccaggaagtcccggtcctcctggcccagctggcatagcaactaagggcctcaatggacccaccgggccaccagggcctccaggtccaagaggcccctctggagagcctggtcttccagggccccctgggcctccaggcccaccaggtcaagcagtcatgcctgagggttttataaaggcaggccaaaggcccagtctttctgggacccctcttgttagtgccaaccagggggtaacaggaatgcctgtgtctgcttttactgttattctctccaaagcttacccagcaataggaactcccataccatttgataaaattttgtataacaggcaacagcattatgacccaaggactggaatctttacttgtcagataccaggaatatactatttttcataccacgtgcatgtgaaagggactcatgtttgggtaggcctgtataagaatggcacccctgtaatgtacacctatgatgaatacaccaaaggctacctggatcaggcttcagggagtgccatcatcgatctcacagaaaatgaccaggtgtggctccagcttcccaatgccgagtcaaatggcctatactcctctgagtatgtccactcctctttctcaggattcctagtggctccaatgtgagtacaccccacagagctaatctaaatcttgtgctagaaaaagcattctctaactctaccccaccctacaaaatgcatatggaggtaggctgaaaagaatgtaatttttattttctgaaatacagatttgagctatcagaccaacaaaccttccccctgaaaagtgagcagcaacgtaaaaacgtatgtgaagcctctcttgaatttctagttagcaatcttaaggctctttaaggttttctccaatattaaaaaatatcaccaaagaagtcctgctatgttaaaaacaaacaacaaaaaacaaagcaacaaaaaaaaaaattaaaaaaaaaaacagaaatagagctctaagttatgtgaaatttgatttgagaaactcggcatttcctttttaaaaaagcctgtttctaactatgaatatgagaacttctaggaaacatccaggaggtatcatataactttgtagaacttaaatacttgaatattcaaatttaaaagacactgtatcccctaaaatatttctgatggtgcactactctgaggcctgtatggcccctttcatcaatatctattcaaatatacaggtgcatatatacttgttaaagctcttatataaaaaagccccaaaatattgaagttcatctgaaatgcaaggtgctttcatcaatgaaccttttcaaaacttttctatgattgcagagaagctttttatatacccagcataacttggaaacaggtatctgacctattcttatttagttaacacaagtgtgattaatttgatttctttaattccttattgaatcttatgtgatatgattttctggatttacagaacattagcacatgtaccttgtgcctcccattcaagtgaagttataatttacactgagggtttcaaaattcgactagaagtggagatatattatttatttatgcactgtactgtatttttatattgctgtttaaaacttttaagctgtgcctcacttattaaagcacaaaatgttttacctactccttatttacgacacaataaaataacatcaatagatttttaggctgaattaatttgaaagcagcaatttgctgttctcaaccattctttcaaggcttttcattcgacacaataaaataacatcaatagatttttagg

SEQ ID NO: 3 - DNA, 5208 bp, Human
tgtgcgccggggaggcgccggcttgtactcggcagcgcgggaataaagtttgctgatttggtgtctagcctggatgcctgggttgcaggcctgcttgtggtggcgctccacagtcatccggctgaaggagacctgttggactggatcttctcgggttttctttcagatattgttttgtatttacccatgaagacattgttttttggactttgcaaataggacatttcaaagatgagtgaaaaaaaattggaaacaactgcacagcagcggaaatgtcctgaatggatgaatgtgcagaataaaagatgtgctgtagaagaaagaaaggcatgtgttcggaagagtgtttttgaagatgacctccccttcttagaattcactggatccattgtgtatagttacgatgctagtgattgctctttcctgtcagaagatattagcatgagtctatcagatggggatgtggtgggatttgacatggagtggccaccattatacaatagagggaaacttggcaaagttgcactaattcagttgtgtgtttctgagagcaaatgttacttgttccacgtttcttccatgtcagtttttccccagggattaaaaatgttgcttgaaaataaagcagttaaaaaggcaggtgtaggaattgaaggagatcagtggaaacttctacgtgactttgatatcaaattgaagaattttgtggagttgacagatgttgccaataaaaagctgaaatgtacagagacctggagccttaacagtctggttaaacacctcttaggtaaacagctcctgaaagacaagtctatccgctgtagcaattggagtaaatttcctctcactgaggaccagaaactgtatgcagccactgatgcttatgctggttttattatttaccgaaatttagagattttggatgatactgtgcaaaggtttgctataaataaagaggaagaaatcctacttagcgacatgaacaaacagttgacttcaatctctgaggaagtgatggatctggctaagcatcttcctcatgctttcagtaaattggaaaacccacggagggtttctatcttactaaaggatatttcagaaaatctatattcactgaggaggatgataattgggtctactaacattgagactgaactgaggcccagcaataatttaaacttattatcctttgaagattcaactactgggggagtacaacagaaacaaattagagaacatgaagttttaattcacgttgaagatgaaacatgggacccaacacttgatcatttagctaaacatgatggagaagatgtacttggaaataaagtggaacgaaaagaagatggatttgaagatggagtagaagacaacaaattgaaagagaatatggaaagagcttgtttgatgtcgttagatattacagaacatgaactccaaattttggaacagcagtctcaggaagaatatcttagtgatattgcttataaatctactgagcatttatctcccaatgataatgaaaacgatacgtcctatgtaattgagagtgatgaagatttagaaatggagatgcttaagcatttatctcccaatgataatgaaaacgatacgtcctatgtaattgagagtgatgaagatttagaaatggagatgcttaagtctttagaaaacctcaatagtggcacggtagaaccaactcattctaaatgcttaaaaatggaaagaaatctgggtcttcctactaaagaagaagaagaagatgatgaaaatgaagctaatgaaggggaagaagatgatgataaggactttttgtggccagcacccaatgaagagcaagttacttgcctcaagatgtactttggccattccagttttaaaccagttcagtggaaagtgattcattcagtattagaagaaagaagagataatgttgctgtcatggcaactggatatggaaagagtttgtgcttccagtatccacctgtttatgtaggcaagattggccttgttatctctccccttatttctctgatggaagaccaagtgctacagcttaaaatgtccaacatcccagcttgcttccttggatcagcacagtcagaaaatgttctaacagatattaaattaggtaaataccggattgtatacgtaactccagaatactgttcaggtaacatgggcctgctccagcaacttgaggctgatattggtatcacgctcattgctgtggatgaggctcactgtatttctgagtgggggcatgattttagggattcattcaggaagttgggctccctaaagacagcactgccaatggttccaatcgttgcacttactgctactgcaagttcttcaatccgggaagacattgtacgttgcttaaatctgagaaatcctcagatcacctgtactggttttgatcgaccaaacctgtatttagaagttaggcgaaaaacagggaatatccttcaggatctgcagccatttcttgtcaaaacaagttcccactgggaatttgaaggtccaacaatcatctactgtccttctagaaaaatgacacaacaagttacaggtgaacttaggaaacttaatctatcctgtggaacataccatgcgggcatgagttttagcacaaggaaagacattcatcataggtttgtaagagatgaaattcagtgtgtcatagctaccatagcttttggaatgggcattaataaagctgacattcgccaagtcattcattacggtgctcctaaggacatggaatcatattatcaggagattggtagagctggtcgtgatggacttcaaagttcttgtcacgtcctctgggctcctgcagacattaacttaaataggcaccttcttactgagatacgtaatgagaagtttcgattatacaaattaaagatgatggcaaagatggaaaaatatcttcattctagcagatgtaggagacaaatcatcttgtctcattttgaggacaaacaagtacaaaaagcctccttgggaattatgggaactgaaaaatgctgtgataattgcaggtccagattggatcattgctattccatggatgactcagaggatacatcctgggactttggtccacaagcatttaagcttttgtctgctgtggacatcttaggcgaaaaatttggaattgggcttccaattttatttctccgaggatctaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaagggtagaaattggcttcataaagctaatacagaatctcagagcctcatccttcaagctaatgaagaattgtgtccaaagaagtttcttctgcctagttcgaaaactgtatcttcgggcaccaaagagcattgttataatcaagtaccagttgaattaagtacagagaagaagtctaacttggagaagttatattcttataaaccatgtgataagatttcttctgggagtaacatttctaaaaaaagtatcatggtacagtcaccagaaaaagcttacagttcctcacagcctgttatttcggcacaagagcaggagactcagattgtgttatatggcaaattggtagaagctaggcagaaacatgccaataaaatggatgttcccccagctattctggcaacaaacaagatactggtggatatggccaaaatgagaccaactacggttgaaaacgtaaaaaggattgatggtgtttctgaaggcaaagctgccatgttggcccctctgttggaagtcatcaaacatttctgccaaacaaatagtgttcagacagacctcttttcaagtacaaaacctcaagaagaacagaagacgagtctggtagcaaaaaataaaatatgcacactttcacagtctatggccatcacatactctttattccaagaaaagaagatgcctttgaagagcatagctgagagcaggattctgcctctcatgacaattggcatgcacttatcccaagcggtgaaagctggctgcccccttgatttggagcgagcaggcctgactccagaggttcagaagattattgctgatgttatccgaaaccctcccgtcaactcagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatactgagacttcatctgcagagagaaagagacgattacctgtgtggtttgccaaaggaagtgataccagcaagaaattaatggacaaaacgaaaaggggaggtctttttagttaagctggcaattaccagaacaattatgtttcttgctgtattataagaggatagctatattttatttctgaagagtaaggagtagtattttggcttaaaaatcattctaattacaaagttcactgtttattgaagaactggcatcttaaatcagccttccgcaattcatgtagtttctgggtcttctgggagcctacgtgagtacatcacctaacagaatattaaattagacttcctgtaagattgctttaagaaactgttactgtcctgttttctaatctctttattaaaacagtgtatttggaaaatgttatgtgctctgatttgatatagataacagattagtagttacatggtaattatgtgatataaaatattcatatattatcaaaattctgttttgtaaatgtaagaaagcatagttattttacaaattgtttttactgtcttttgaagaagttcttaaatacgttgttaaatggtattagttgaccagggcagtgaaaatgaaaccgcattttgggtgccattaaatagggaaaaaacatgtaaaaaatgtaaaatggagaccaattgcactaggcaagtgtatattttgtattttatatacaatttctattatttttcaagtaataaaacaatgtttttcatactgaatattaaaaaaaaaaaaaaaaaaaa

SEQ ID NO: 4 - DNA, 1514 bp, Human
atcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatatattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtcgataatggaaacatttacaataaatattctgcatggaaa

SEQ ID NO: 5 - DNA, 4989 bp, Human
ttttttttttttttgagaaagggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggaggcaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagttctgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggc

SEQ ID NO: 6 - DNA, 3331 bp, Human
cagaattccaggacaaagagatcttcaaaaatcaaaaatgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcaggagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttgaatgtgaaggcaaacacagcatcgtgatcactgagccatcatttcctgggagaaagaccatgcatttaaagtattctccatcctcccaggaaccgaacatatcatttgtgaagaattattcagtgaatttgtccattgtaaatctgaagaaagttattcttggtactgttgctttgggagacagtctaggaatggagtctcccactgcaacttgtgaactccatcattcatccaggactgagatgcaaatgtcacagtaatgcaagcaaagtatcaaagaaaaacaatgaaattgacctagttcagatacagggtgctccttgtcaatactgagccatttatacctttgaaatattaaaatcactgtcaatatttttatttttaactctggattttgaattagattatttctgtatttggctatggatctgatttttaatttttttaaatttcagtcaattctgatgttactgagatgttttaccatccttacaatgtaaaccacatgaactacgtgacctctgcaagacaaagcggctttctaatagagagattagtaaatatgtgaagaaaaagacctgcatttggcaggaagatgtatgctttgaatgcaaaagaaatttagagtcaatttgctgaaaacattacatgctcagcttggttttggacaagcctgtccattgggcaggacctagctgttgtaaagaattggtcttaatgttgaatgtattttggttgctgatgtttataaactgagaggtcacaaagaatctatcactaaaaatttttacaaaactgccaaaaatataattcttagtggaagacaatactccctttaaagagagtttgccactcccctaaactccaggatttataaagcaaattactccaaggtttataaagcagattacctcttgcccttgggtgctatctagcagtaaaagataaatttgttgaatattggtaattaaaagactccacataagtccattaactgctttccacccagcttcaaagcttaaaaagagctcaggcttttccaggaagatccaggagggctaattagaaatcaacttgtggttgaccgcttgtttcttgttattaccaaacaggaggggaaaaaattaactgctccaaatttaaccataaatcaattcatgtttaacgtttctcattaaaatccagtattatattatcatatctctctttacttcccagtataagatttttgaaaatcctgaataaaccagtatcgttactggcacctgaaattaatttgtgaatttgcaacagtaatcagagttaccattatttaatttgtatgctaaatgaggaggtacattgaaaccctccaaatctccagtctcatctatgtcatattttgccactgcctttcagaagtgatttagttgtggaaagataataaattgatttgttatggttacatatttagcgcacccagagaaaattaattatatttctacagagaaaatgaatttgggatactaaagtagtttaagtctcctttactgaatgtaagggggggatcgaaaagaaggtatttttccaatcacagtgttatgtagtattgttctatttttgtttacaaacatggaaaacagagtatttctggcagctgtggtacaaatgtgataatatattgctaaaatattttagatgttattatgctaatatagtaggggttgaagaaaacaaaatagcttattatagaattgcacatagttctgcccaaattatgtgaaatgcttatgcttgtgtatatgtataaattaatacagagtacgttaaaagcaaaaagatgtatatttgcatatttttctaaagaaatatattattcatcttttcattc

SEQ ID NO: 7 - DNA, 3167 bp, Human
atgctgccacaaataccctttttgctgctagtatccttgaacttggttcatggagtgttttacgctgaacgataccaaatgcccacaggcataaaaggcccactacccaacaccaagacacagttcttcattccctacaccataaagagtaaaggtatagcagtaagaggagagcaaggtactcctggtccaccaggccctgctggacctcgagggcacccaggtccttctggaccaccaggaaaaccaggctacggaagtcctggactccaaggagagccagggttgccaggaccaccgggaccatcagctgtagggaaaccaggtgtgccaggactcccaggaaaaccaggagagagaggaccatatggaccaaaaggagatgttggaccagctggcctaccaggaccccggggcccaccaggaccacctggaatccctggaccggctggaatttctgtgccaggaaaacctggacaacagggacccacaggagccccaggacccaggggctttcctggagaaaagggtgcaccaggagtccctggtatgaatggacagaaaggggaaatgggatatggtgctcctggtcgtccaggtgagaggggtcttccaggccctcagggtcccacaggaccatctggccctcctggagtgggaaaaagaggtgaaaatggggttccaggacagccaggcatcaaaggtgatagaggttttccgggagaaatgggaccaattggcccaccaggtccccaaggccctcctggggaacgagggccagaaggcattggaaagccaggagctgctggagccccaggccagccagggattccaggaacaaaaggtctccctggggctccaggaatagctgggcccccagggcctcctggctttgggaaaccaggcttgccaggcctgaagggagaaagaggacctgctggccttcctgggggtccaggtgccaaaggggaacaagggccagcaggtcttcctgggaagccaggtctgactggaccccctgggaatatgggaccccaaggaccaaaaggcatcccgggtagccatggtctcccaggccctaaaggtgagacagggccagctgggcctgcaggataccctggggctaagggtgaaaggggttcccctgggtcagatggaaaaccagggtacccaggaaaaccaggtctcgatggtcctaagggtaacccagggttaccaggtccaaaaggtgatcctggagttggaggacctcctggtctcccaggccctgtgggcccagcaggagcaaagggaatgcccggacacaatggagaggctggcccaagaggtgcccctggaataccaggtactagaggccctattgggccaccaggcattccaggattccctgggtctaaaggggatccaggaagtcccggtcctcctggcccagctggcatagcaactaagggcctcaatggacccaccgggccaccagggcctccaggtccaagaggccactctggagagcctggtcttccagggccccctgggcctccaggcccaccaggtcaagcagtcatgcctgagggttttataaaggcaggccaaaggcccagtctttctgggacccctcttgttagtgccaaccagggggtaacaggaatgcctgtgtctgcttttactgttattctctccaaagcttacccagcaataggaactcccataccatttgataaaattttgtataacaggcaacagcattatgacccaaggactggaatctttacttgtcagataccaggaatatactatttttcataccacgtgcatgtgaaagggactcatgtttgggtaggcctgtataagaatggcacccctgtaatgtacacctatgatgaatacaccaaaggctacctggatcaggcttcagggagtgccatcatcgatctcacagaaaatgaccaggtgtggctccagcttcccaatgccgagtcaaatggcctatactcctctgagtatgtccactcctctttctcaggattcctagtggctccaatgtgagtacaccccacagagctaatctaaatcttgtgctagaaaaagcattctctaactctaccccaccctacaaaatgcatatggaggtaggctgaaaagaatgtaatttttattttctgaaatacagatttgagctatcagaccaacaaaccttccccctgaaaagtgagcagcaacgtaaaaacgtatgtgaagcctctcttgaatttctagttagcaatcttaaggctctttaaggttttctccaatattaaaaaatatcaccaaagaagtcctgctatgttaaaaacaaacaacaaaaaacaaacaacaaaaaaaaaattaaaaaaaaaaacagaaatagagctctaagttatgtgaaatttgatttgagaaactcggcatttcctttttaaaaaagcctgtttctaactatgaatatgagaacttctaggaaacatccaggaggtatcatataactttgtagaacttaaatacttgaatattcaaatttaaaagacactgtatcccctaaaatatttctgatggtgcactactctgaggcctgtatggcccctttcatcaatatctattcaaatatacaggtgcatatatacttgttaaagctcttatataaaaaagccccaaaatattgaagttcatctgaaatgcaaggtgctttcatcaatgaaccttttcaaacttttctatgattgcagagaagctttttatatacccagcataacttggaaacaggtatctgacctattcttatttagttaacacaagtgtgattaatttgatttctttaattccttattgaatcttatgtgatatgattttctggatttacagaacattagcacatgtaccttgtgcctcccattcaagtgaagttataatttacactgagggtttcaaaattcgactagaagtggagatatattatttatttatgcactgtactgtatttttatattgctgtttaaaacttttaagctgtgcctcacttattaaagcacaaaatgttttacctactccttatttacgacgcaataaaataacatcaatagatttttaggctgaattaatttgaaagcagcaatttgctgttctcaaccattctttcaaggcttttcattgttcaa

SEQ ID NO: 8 - DNA, 4990 bp, Human
ttttttttttttttgagaaaggggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggc

SEQ ID NO: 9 - DNA, 5365 bp, Human
tgtgcgccggggaggcgccggcttgtactcggcagcgcgggaataaagtttgctgatttggtgtctagcctggatgcctgggttgcaggccctgcttgtggtggcgctccacagtcatccggctgaagaagacctgttggactggatcttctcgggttttctttcagatattgttttgtatttacccatgaagacattgttttttggactctgcaaataggacatttcaaagatgagtgaaaaaaaattggaaacaactgcacagcagcggaaatgtcctgaatggatgaatgtgcagaataaaagatgtgctgtagaagaaagaaaggcatgtgttcggaagagtgtttttgaagatgacctccccttcttagaattcactggatccattgtgtatagttacgatgctagtgattgctctttcctgtcagaagatattagcatgagtctatcagatggggatgtggtgggatttgacatggagtggccaccattatacaatagagggaaacttggcaaagttgcactaattcagttgtgtgtttctgagagcaaatgttacttgttccacgtttcttccatgtcagtttttccccagggattaaaaatgttgcttgaaaataaagcagttaaaaaggcaggtgtaggaattgaaggagatcagtggaaacttctacgtgactttgatatcaaattgaagaattttgtggagttgacagatgttgccaataaaaagctgaaatgcacagagacctggagccttaacagtctggttaaacacctcttaggtaaacagctcctgaaagacaagtctatccgctgtagcaattggagtaaatttcctctcactgaggaccagaaactgtatgcagccactgatgcttatgctggttttattatttaccgaaatttagagattttggatgatactgtgcaaaggtttgctataaataaagaggaagaaatcctacttagcgacatgaacaaacagttgacttcaatctctgaggaagtgatggatctggctaagcatcttcctcatgctttcagtaaattggaaaacccacggagggtttctatcttactaaaggatatttcagaaaatctatattcactgaggaggatgataattgggtctactaacattgagactgaactgaggcccagcaataatttaaacttattatcctttgaagattcaactactgggggagtacaacagaaacaaattagagaacatgaagttttaattcacgttgaagatgaaacatgggacccaacacttgatcatttagctaaacatgatggagaagatgtacttggaaataaagtggaacgaaaagaagatggatttgaagatggagtagaagacaacaaattgaaagagaatatggaaagagcttgtttgatgtcgttagatattacagaacatgaactccaaattttggaacagcagtctcaggaagaatatcttagtgatattgcttataaatctactgagcatttatctcccaatgataatgaaaacgatacgtcctatgtaattgagagtgatgaagatttagaaatggagatgcttaagtctttagaaaacctcaatagtggcacggtagaaccaactcattctaaatgcttaaaaatggaaagaaatctgggtcttcctactaaagaagaagaagaagatgatgaaaatgaagctaatgaaggggaagaagatgatgataaggactttttgtggccagcacccaatgaagagcaagttacttgcctcaagatgtactttggccattccagttttaaaccagttcagtggaaagtgattcattcagtattagaagaaagaagagataatgttgctgtcatggcaactggatatggaaagagtttgtgcttccagtatccacctgtttatgtaggcaagattggccttgttatctctccccttatttctctgatggaagaccaagtgctacagcttaaaatgtccaacatcccagcttgcttccttggatcagcacagtcagaaaatgttctaacagatattaaattaggtaaataccggattgtatacgtaactccagaatactgttcaggtaacatgggcctgctccagcaacttgaggctgatattggtatcacgctcattgctgtggatgaggctcactgtatttctgagtgggggcatgattttagggattcattcaggaagttgggctccctaaagacagcactgccaatggttccaatcgttgcacttactgctactgcaagttcttcaatccgggaagacattgtacgttgcttaaatctgagaaatcctcagatcacctgtactggttttgatcgaccaaacctgtatttagaagttaggcgaaaaacagggaatatccttcaggatctgcagccatttcttgtcaaaacaagttcccactgggaatttgaaggtccaacaatcatctactgtccttctagaaaaatgacacaacaagttacaggtgaacttaggaaactgaatctatcctgtggaacataccatgcgggcatgagttttagcacaaggaaagacattcatcataggtttgtaagagatgaaattcagtgtgtcatagctaccatagcttttggaatgggcattaataaagctgacattcgccaagtcattcattacggtgctcctaaggacatggaatcatattatcaggagattggtagagctggtcgtgatggacttcaaagttcttgtcacgtcctctgggctcctgcagacattaacttaaataggcaccttcttactgagatacgtaatgagaagtttcgattatacaaattaaagatgatggcaaagatggaaaaatatcttcattctagcagatgtaggagacaaatcatcttgtctcattttgaggacaaacaagtacaaaaagcctccttgggaattatgggaactgaaaaatgctgtgataattgcaggtccagattggatcattgctattccatggatgactcagaggatacatcctgggactttggtccacaagcatttaagcttttgtctgctgtggacatcttaggcgaaaaatttggaattgggcttccaattttatttctccgaggatctaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaagggtagaaattggcttcataaagctaatacagaatctcagagcctcatccttcaagctaatgaagaattgtgtccaaagaagttgcttctgcctagttcgaaaactgtatcttcgggcaccaaagagcattgttataatcaagtaccagttgaattaagtacagagaagaagtctaacttggagaagttatattcttataaaccatgtgataagatttcttctgggagtaacatttctaaaaaaagtatcatggtacagtcaccagaaaaagcttacagttcctcacagcctgttatttcggcacaagagcaggagactcagattgtgttatatggcaaattggtagaagctaggcagaaacatgccaataaaatggatgttcccccagctattctggcaacaaacaagatactggtggatatggccaaaatgagaccaactacggttgaaaacgtaaaaaggattgatggtgtttctgaaggcaaagctgccatgttggcccctctgttggaagtcatcaaacatttctgccaaacaaatagtgttcagacagacctcttttcaagtacaaaacctcaagaagaacagaagacgagtctggtagcaaaaaataaaatatgcacactttcacagtctatggccatcacatactctttattccaagaaaagaagatgcctttgaagagcatagctgagagcaggattctgcctctcatgacaattggcatgcacttatcccaagcggtgaaagctggctgcccccttgatttggagcgagcaggcctgactccagaggttcagaagattattgctgatgttatccgaaaccctcccgtcaactcagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatactgagacttcatctgcagagagaaagagacgattacctgtgtggtttgccaaaggaagtgataccagcaagaaattaatggacaaaacgaaaaggggaggtctttttagttaagctggcaattaccagaacaattatgtttcttgctgtattataagaggatagctatattttatttctgaagagtaaggagtagtattttggcttaaaaatcattctaattacaaagttcactgtttattgaagaactggcatcttaaatcagccttccgcaattcatgtagtttctgggtcttctgggagcctacgtgagtacatcacctaacagaatattaaattagacttcctgtaagattgctttaagaaactgttactgtcctgttttctaatctctttattaaaacagtgtatttggaaaatgttatgtgctctgatttgatatagataacagattagtagttacatggtaattatgtgatataaaatattcatatattatcaaaattctgttttgtaaatgtaagaaagcatagttattttacaaattgtttttactgtcttttgaagaagttcttaaatacgttgttaaatggtattagttgaccagggcagtgaaaatgaaaccgcattttgggtgccattaaatagggaaaaaacatgtaaaaaatgtaaaatggagaccaattgcactaggcaagtgtatattttgtattttatatacaatttctattatttttcaagtaataaaacaatgtttttcatactgaatattatatatatattttttagctttcatttacttaattattttaagtacctttatttttccaggatgtcagaatttgattctaatctctcttatgtagcacatgtgacttaatttaaaacctatactgtgacacagagttgggtaaacgatgattatttaactttaagcagttcaccatccatttcaaagcctttgattggcttttttgtaaataaaaataacttgttaagaaacaaatatatctgtcatagaagaactag

SEQ ID NO: 10 - DNA, 1514 bp, Human
atcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatatattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaa

SEQ ID NO: 11 - DNA, 288 bp, Human
atggatgaaatgcaagtactcaggccctttgaactagaatttttgcctaaactgaaagagttgctcctgatggcagatgtaaattgggatgtcgccagcctccgcagcagcggctgcagcgcgagcagagcggttggaggggcgcctcccccaacgctggttccactgaattttgaattgggcccattggcgcttcacggtggtttggacctggaagagaaaaaggagccttgtttttatatgatagtcagaaatgatccatgcaaagtgtacgaacatcgttcttag

SEQ ID NO: 12 - DNA, 3326 bp, Human
ttctaggacaaagagatcttcaaaaatcaaaaatgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcaggagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttgaatgtgaagcaaacacagcatcgtgatcactgagccatcatttcctgggagaaagaccatgcatttaaagtattctccatcctcccaggaaccgaacatatcatttgtgaagaattattcagtgaatttgtccattgtaaatctgaagaaagttattcttggtactgttgctttgggagacagtctaggaatggagtctcccactgcaacttgtgaactccatcattcatccaggactgagatgcaaatgtcacagtaatgcaagcaaagtatcaaagaaaaacaatgaaattgacctagttcagatacagggtgctccttgtcaatactgagccatttatacctttgaaatattaaaatcactgtcaatatttttatttttaactctggattttgaattagattatttctgtatttggctatggatctgatttttaatttttttaaatttcagtcaattctgatgttactgagatgttttaccatccttacaatgtaaaccacatgaactacgtgacctctgcaagacaaagcggctttctaatagagagattagtaaatatgtgaagaaaaagacctgcatttggcaggaagatgtatgctttgaatgcaaaagaaatttagagtcaatttgctgaaaacattacatgctcagcttggttttggacaagcctgtccattgggcaggacctagctgttgtaaagaattggtcttaatgttgaatgtattttggttgctgatgtttataaactgagaggtcacaaagaatctatcactaaaaatttttacaaaactgccaaaaatataattcttagtggaagacaatactccctttaaagagagtttgccactcccctaaactccaggatttataaagcaaattactccaaggtttataaagcagattacctcttgcccttgggtgctatctagcagtaaaagataaatttgttgaatattggtaattaaaagactccacataagtccattaactgctttccacccagcttcaaagcttaaaaagagctcaggcttttccaggaagatccaggagggctaattagaaatcaacttgtggttgaccgcttgtttcttgttattaccaaaacaggaggggaaaaaattaactgctccaaatttaaccataaatcaattcatgtttaacgtttctcattaaaatccagtattatattatcatatctctctttacttcccagtataagatttttgaaaatcctgaataaaccagtatcgttactggcacctgaaattaatttgtgaatttgcaacagtaatcagagttaccattatttaatttgtatgctaaatgaggaggtacattgaaaccctccaaatctccagtctcatctatgtcatattttgccactgcctttcagaagtgatttagttgtggaaagataataaattgatttgttatggttacatatttagcgcacccagagaaaattaattatatttctacagagaaaatgaatttgggatactaaagtagtttaagtctcctttactgaatgtaagggggggatcgaaaagaaggtatttttccaatcacagtgttatgtagtattgttctatttttgtttacaaacatggaaaacagagtatttctggcagctgtggtacaaatgtgataatatattgctaaaatattttagatgttattatgctaatatagtaggggttgaagaaaacaaaatagcttattatagaattgcacatagttctgcccaaattatgtgaaatgcttatgcttgtgtatatgtataaattaatacagagtacgttaaaagcaaaaagatgtatatttgcatatttttctaaagaaatatattattcatcttttcattc

SEQ ID NO: 13 - DNA, 3597 bp, Human
ggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtgtccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacatggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctgtgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctc

SEQ ID NO: 14 - protein, 825 aa, Human
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 15 - protein, 680 aa, Human
MLPQIPFLLLVSLNLVHGVFYAERYQTPTGIKGPLPNTKTQFFIPYTIKSKGIAVRGEQGTPGPPGPAGPRGHPGPSGPPGKPGYGSPGLQGEPGLPGPPGPSAVGKPGVPGLPGKPGERGPYGPKGDVGPAGLPGPRGPPGPPGIPGPAGISVPGKPGQQGPTGAPGPRGFPGEKGAPGVPGMNGQKGEMGYGAPGRPGERGLPGPQGPTGPSGPPGVGKRGENGVPGQPGIKGDRGFPGEMGPIGPPGPQGPPGERGPEGIGKPGAAGAPGQPGIPGTKGLPGAPGIAGPPGPPGFGKPGLPGLKGERGPAGLPGGPGAKGEQGPAGLPGKPGLTGPPGNMGPQGPKGIPGSHGLPGPKGETGPAGPAGYPGAKGERGSPGSDGKPGYPGKPGLDGPKGNPGLPGPKGDPGVGGPPGLPGPVGPAGAKGMPGHNGEAGPRGAPGIPGTRGPIGPPGIPGFPGSKGDPGSPGPPGPAGIATKGLNGPTGPPGPPGPRGPSGEPGLPGPPGPPGPPGQAVMPEGFIKAGQRPSLSGTPLVSANQGVTGMPVSAFTVILSKAYPAIGTPIPFDKILYNRQQHYDPRTGIFTCQIPGIYYFSYHVHVKGTHVWVGLYKNGTPVMYTYDEYTKGYLDQASGSAIIDLTENDQVWLQLPNAESNGLYSSEYVHSSFSGFLVAPM

SEQ ID NO: 16 - protein, 1432 aa, Human
MSEKKLETTAQQRKCPEWMNVQNKRCAVEERKACVRKSVFEDDLPFLEFTGSIVYSYDASDCSFLSEDISMSLSDGDVVGFDMEWPPLYNRGKLGKVALIQLCVSESKCYLFHVSSMSVFPQGLKMLLENKAVKKAGVGIEGDQWKLLRDFDIKLKNFVELTDVANKKLKCTETWSLNSLVKHLLGKQLLKDKSIRCSNWSKFPLTEDQKLYAATDAYAGFIIYRNLEILDDTVQRFAINKEEEILLSDMNKQLTSISEEVMDLAKHLPHAFSKLENPRRVSILLKDISENLYSLRRMIIGSTNIETELRPSNNLNLLSFEDSTTGGVQQKQIREHEVLIHVEDETWDPTLDHLAKHDGEDVLGNKVERKEDGFEDGVEDNKLKENMERACLMSLDITEHELQILEQQSQEEYLSDIAYKSTEHLSPNDNENDTSYVIESDEDLEMEMLKHLSPNDNENDTSYVIESDEDLEMEMLKSLENLNSGTVEPTHSKCLKMERNLGLPTKEEEEDDENEANEGEEDDDKDFLWPAPNEEQVTCLKMYFGHSSFKPVQWKVIHSVLEERRDNVAVMATGYGKSLCFQYPPVYVGKIGLVISPLISLMEDQVLQLKMSNIPACFLGSAQSENVLTDIKLGKYRIVYVTPEYCSGNMGLLQQLEADIGITLIAVDEAHCISEWGHDFRDSFRKLGSLKTALPMVPIVALTATASSSIREDIVRCLNLRNPQITCTGFDRPNLYLEVRRKTGNILQDLQPFLVKTSSHWEFEGPTIIYCPSRKMTQQVTGELRKLNLSCGTYHAGMSFSTRKDIHHRFVRDEIQCVIATIAFGMGINKADIRQVIHYGAPKDMESYYQEIGRAGRDGLQSSCHVLWAPADINLNRHLLTEIRNEKFRLYKLKMMAKMEKYLHSSRCRRQIILSHFEDKQVQKASLGIMGTEKCCDNCRSRLDHCYSMDDSEDTSWDFGPQAFKLLSAVDILGEKFGIGLPILFLRGSNSQRLADQYRRHSLFGTGKDQTESWWKAFSRQLITEGFLVEVSRYNKFMKICALTKKGRNWLHKANTESQSLILQANEELCPKKFLLPSSKTVSSGTKEHCYNQVPVELSTEKKSNLEKLYSYKPCDKISSGSNISKKSIMVQSPEKAYSSSQPVISAQEQETQIVLYGKLVEARQKHANKMDVPPAILATNKILVDMAKMRPTTVENVKRIDGVSEGKAAMLAPLLEVIKHFCQTNSVQTDLFSSTKPQEEQKTSLVAKNKICTLSQSMAITYSLFQEKKMPLKSIAESRILPLMTIGMHLSQAVKAGCPLDLERAGLTPEVQKIIADVIRNPPVNSDMSKISLIRMLVPENIDTYLIHMAIEILKHGPDSGLQPSCDVNKRRCFPGSEEICSSSKRSKEEVGINTETSSAERKRRLPVWFAKGSDTSKKLMDKTKRGGLFS

SEQ ID NO: 17 - protein, 259 aa, Human
MSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKEPCRIELYRVVESLAKAQETSGEEISKFYLPNCNKNGFYHSRQCETSMDGEAGLCWCVYPWNGKRIPGSPEIRGDPNCQIYFNVQN

SEQ ID NO: 18 - protein, 1367 aa, Human
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 19 - protein, 474 aa, Human
MRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRSLGCQRVTLHKNMFLTYILNSMIIIIHLVEVVPNGELVRRDPVSCKILHFFHQYMMACNYFWMLCEGIYLHTLIVVAVFTEKQRLRWYYLLGWGFPLVPTTIHAITRAVYFNDNCWLSVETHLLYIIHGPVMAALVVNFFFLLNIVRVLVTKMRETHEAESHMYLKAVKATMILVPLLGIQFVVFPWRPSNKMLGKIYDYVMHSLIHFQGFFVATIYCFCNNEVQTTVKRQWAQFKIQWNQRWGRRPSNRSARAAAAAAEAGDIPIYICHQELRNEPANNQGEESAEIIPLNIIEQESSA

SEQ ID NO: 20 - protein, 680 aa, Human
MLPQIPFLLLVSLNLVHGVFYAERYQMPTGIKGPLPNTKTQFFIPYTIKSKGIAVRGEQGTPGPPGPAGPRGHPGPSGPPGKPGYGSPGLQGEPGLPGPPGPSAVGKPGVPGLPGKPGERGPYGPKGDVGPAGLPGPRGPPGPPGIPGPAGISVPGKPGQQGPTGAPGPRGFPGEKGAPGVPGMNGQKGEMGYGAPGRPGERGLPGPQGPTGPSGPPGVGKRGENGVPGQPGIKGDRGFPGEMGPIGPPGPQGPPGERGPEGIGKPGAAGAPGQPGIPGTKGLPGAPGIAGPPGPPGFGKPGLPGLKGERGPAGLPGGPGAKGEQGPAGLPGKPGLTGPPGNMGPQGPKGIPGSHGLPGPKGETGPAGPAGYPGAKGERGSPGSDGKPGYPGKPGLDGPKGNPGLPGPKGDPGVGGPPGLPGPVGPAGAKGMPGHNGEAGPRGAPGIPGTRGPIGPPGIPGFPGSKGDPGSPGPPGPAGIATKGLNGPTGPPGPPGPRGHSGEPGLPGPPGPPGPPGQAVMPEGFIKAGQRPSLSGTPLVSANQGVTGMPVSAFTVILSKAYPAIGTPIPFDKILYNRQQHYDPRTGIFTCQIPGIYYFSYHVHVKGTHVWVGLYKNGTPVMYTYDEYTKGYLDQASGSAIIDLTENDQVWLQLPNAESNGLYSSEYVHSSFSGFLVAPM

SEQ ID NO: 21 - protein, 1377 aa, Human
ERGISSQIKGMKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 22 - protein, 1409 aa, Human
DISKMSEKKLETTAQQRKCPEWMNVQNKRCAVEERKACVRKSVFEDDLPFLEFTGSIVYSYDASDCSFLSEDISMSLSDGDVVGFDMEWPPLYNRGKLGKVALIQLCVSESKCYLFHVSSMSVFPQGLKMLLENKAVKKAGVGIEGDQWKLLRDFDIKLKNFVELTDVANKKLKCTETWSLNSLVKHLLGKQLLKDKSIRCSNWSKFPLTEDQKLYAATDAYAGFIIYRNLEILDDTVQRFAINKEEEILLSDMNKQLTSISEEVMDLAKHLPHAFSKLENPRRVSILLKDISENLYSLRRMIIGSTNIETELRPSNNLNLLSFEDSTTGGVQQKQIREHEVLIHVEDETWDPTLDHLAKHDGEDVLGNKVERKEDGFEDGVEDNKLKENMERACLMSLDITEHELQILEQQSQEEYLSDIAYKSTEHLSPNDNENDTSYVIESDEDLEMEMLKSLENLNSGTVEPTHSKCLKMERNLGLPTKEEEEDDENEANEGEEDDDKDFLWPAPNEEQVTCLKMYFGHSSFKPVQWKVIHSVLEERRDNVAVMATGYGKSLCFQYPPVYVGKIGLVISPLISLMEDQVLQLKMSNIPACFLGSAQSENVLTDIKLGKYRIVYVTPEYCSGNMGLLQQLEADIGITLIAVDEAHCISEWGHDFRDSFRKLGSLKTALPMVPIVALTATASSSIREDIVRCLNLRNPQITCTGFDRPNLYLEVRRKTGNILQDLQPFLVKTSSHWEFEGPTIIYCPSRKMTQQVTGELRKLNLSCGTYHAGMSFSTRKDIHHRFVRDEIQCVIATIAFGMGINKADIRQVIHYGAPKDMESYYQEIGRAGRDGLQSSCHVLWAPADINLNRHLLTEIRNEKFRLYKLKMMAKMEKYLHSSRCRRQIILSHFEDKQVQKASLGIMGTEKCCDNCRSRLDHCYSMDDSEDTSWDFGPQAFKLLSAVDILGEKFGIGLPILFLRGSNSQRLADQYRRHSLFGTGKDQTESWWKAFSRQLITEGFLVEVSRYNKFMKICALTKKGRNWLHKANTESQSLILQANEELCPKKLLLPSSKTVSSGTKEHCYNQVPVELSTEKKSNLEKLYSYKPCDKISSGSNISKKSIMVQSPEKAYSSSQPVISAQEQETQIVLYGKLVEARQKHANKMDVPPAILATNKILVDMAKMRPTTVENVKRIDGVSEGKAAMLAPLLEVIKHFCQTNSVQTDLFSSTKPQEEQKTSLVAKNKICTLSQSMAITYSLFQEKKMPLKSIAESRILPLMTIGMHLSQAVKAGCPLDLERAGLTPEVQKIIADVIRNPPVNSDMSKISLIRMLVPENIDTYLIHMAIEILKHGPDSGLQPSCDVNKRRCFPGSEEICSSSKRSKEEVGINTETSSAERKRRLPVWFAKGSDTSKKLMDKTKRGGLFS

SEQ ID NO: 23 - protein, 314 aa, Human
IGHRHPIQRASAAAPPPPSQRALATAPPSLAQSLGHRPPPPAQRASAPVCCSRLEMSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKEPCRIELYRVVESLAKAQETSGEEISKFYLPNCNKNGFYHSRQCETSMDGEAGLCWCVYPWNGKRIPGSPEIRGDPNCQIYFNVQN

SEQ ID NO: 24 - protein, 95 aa, Human
MDEMQVLRPFELEFLPKLKELLLMADVNWDVASLRSSGCSASRAVGGAPPPTLVPLNFELGPLALHGGLDLEEKKEPCFYMIVRNDPCKVYEHRS

SEQ ID NO: 25 - protein, 484 aa, Human
LGQRDLQKSKMRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRSLGCQRVTLHKNMFLTYILNSMIIIIHLVEVVPNGELVRRDPVSCKILHFFHQYMMACNYFWMLCEGIYLHTLIVVAVFTEKQRLRWYYLLGWGFPLVPTTIHAITRAVYFNDNCWLSVETHLLYIIHGPVMAALVVNFFFLLNIVRVLVTKMRETHEAESHMYLKAVKATMILVPLLGIQFVVFPWRPSNKMLGKIYDYVMHSLIHFQGFFVATIYCFCNNEVQTTVKRQWAQFKIQWNQRWGRRPSNRSARAAAAAAEAGDIPIYICHQELRNEPANNQGEESAEIIPLNIIEQESSA

SEQ ID NO: 26 - protein, 839 aa, Human
DQEFETSLVPWHLPMGWLCSGLLFPVSCLVLLQVASSGNMKVLQEPTCVSDYMSISTCEWKMNGPTNCSTELRLLYQLVFLLSEAHTCVPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 27 - DNA, 54779 bp, Human
attgattcaggcactggtcagaggtcacctcctccaggaagccatccctgaccccagggaactgacttatctttactgtcacttctgggggtgggttggtggctgtcttgctcacttggttgtaaggtctcagagggcagggattgtgtctgtttcatgtcttcaggtctgcgtcatcagcgcttgtcacaaggttagacacacagtaggaccaagacagaccaagtacatgaaagaatgattgacatatgggccaggcgtggtggctcacacctgtaatcccagcacttcgggaggcagaggcaggcagatcacctgaggtcaggagtttgataccagcctggccaacatagtgaaacctcatgtctactaaaaatacaaaaatgagccggacgtggtggtgcacgcttgtaattccagctactcaggaggctgaggcaggagaattgcttgaactcaggaagtggaggttgcagtgagctgagatcacccactgcactccagcctaggcaatggaatgagaccccatcttcaaaaaaaaaaaaagaatgattgacgtgcagtggcccctgccctgggaagccaaccctcaccctccaccacagcacttgatcccattgggcagtccttggcttccaccctcaaactgagagctccttgagggcagcagggggtcaaattactctctgggttctcagcactgcccagtgtgagtccaaatatctcccacctcccctgtctccgctctttcctcactcagggctccacagccatgccggccttcagcaattcctcctgcaggctgagctggttcccacagggcctttgcactagctcttccctctccctacacaagtcttcccccataggctcttcagagtctcagctcaaatggcctctactcaaaaagcctcttccagaccacctgccccactggtctaagaggtccctactttcttcttgggccctcctgacctgaaatactttgttgagtgttttccccccagtcatctggctgcatccgggttcttatggtgtccagacgttaatggtctatggggcctgtgttcgaatcccagctccacccctgctcctgcttacctgcagagtgattctgagtttctttcttttcttttttaaaattttataaatgtcaatttttgtagataggggtctcgctaacagggttgcccaggctggtctcgaactatggggttcaagtgatcctcccgcctcagcttcccaaagtgctgggattacaggcatgagccactttgcccaacccattttgaatttcttaaggactctgtgcctcagtttcctgatttgtaaaaccggtgatagtatcactcccttatagggtagttgccaggattgaacgagttaacatttgcagtgcccgacagattgtactagttactgattgaagggctgttttactatccaaatgtggctggagtaggagttgggtaaacatttattgaagaatgtgcaaccactctcacttggaagccgggctgttaggaaggggaggaggattccagtcgcccagccctccccccaccaaacgcaactgccccggcgcaaaagaggccgcggaggccaggcaggagcaggtcctggaggcctggtcggcgtgggcgttttattccgagaccaaggggatccactgcagagttctccgctgggcgtgacctcgggctgcagcgtgggaggaagcgcgcggcaagacacccagcgaggtgctggggtcgcccccaggagaggacggcggctcggactgtccggcggcggcggcggggacagcgacaggggcgcgaggtggccgggacccgggccgggcgcgccgggcggggcggcgcatgcaaatctgccgggcgccggggcggggagcaggaagccggggcgggctgggtctccgcgcccaggaaagccccgcgcggcgcgggccagggaagggccacccaggggtcccccacttcccgcttgggcgcccggacggcgaatggagcaggggcgcgcaggtaggatccggggcccgcgcgcggatcgggttgcgaaggtatcgcccgggcacgccggctgagggcgttcgggaagggctcggccgccggcggggaccacggggaccaccccgactccgagcggggcccgagcccgcgactctcggtgcgcgcggagcagcgcccggttccgtccttgccgccgaacggcagcggaggcgcgaggcccggggtacgtggacacccagcgctccccaaagccggtgctggcagtgagacctccgccgggacggcctgcgggggtggggggcttggggttaggctgtcggaggccacgcagcccctcttctccgggcagtggcgcccagccctgcgctcaggaagtcagtgaggacttcggagagagaaagggtggggaaagttctgagaactgtaaatttgagtagtaggtcagtgaatcggggcggtctccgcctccgaatatcagatggacccaataatcgcgatcattgactgggacttgttttactgaaaggatgccaagtgaaacctcccactaacttctctgtggccggtgctgtgcgtcatggacattgtacagatgaggtcaccaagaccccagccgctttagtaacttgccctaaggtgccgcccacttgggagtccgtggggcagcaggactagagcccaggcaatcccacgccagagccagctgctctccatctctcaatcacgtttgaggagcccccacaataaccagaatctccgggagatttgcttaaaatgcagattcccaggtccttgccctgagattcagattcagtaaacccaggaatctgatctttattttatttttaaaaatttattttataaagatggtgtctcactatgttgtccaggctggcctcaagtgatcctcccacctcggcctcccaaaatgctgggattacaggtgtgagccactgagccctgattttttttttaaacaaaatctggatttcttagacttaagcaagataggggaccactagtttgtctgcttctggggttcaaggaatgcccccaggccagcgctaaccctgctccagttctagtctctccccttccccagccctctgggaggcatgacccactgcacttccctgcccccagtagcctatgaggagcccaaggcatttgctgggacctcagtgcctttatcaaaatcccaaagtccaatggggaaacaggctcaggtgtaggtttggccagggtgtcctgcacattagggcattccagggtcctgcaggggtttcttagaactcggctagcccagcccatgaatgggaggtgacctgctaagccactcattcactcactagcactcattcagctcctgcgaggccctgggtggtgttctgggcactggtgcttgcctcaaggagcaccccctctgcaggaagacagacgtgagggctgggagggtgcggatgcaccagcggctgcaggaccacaagccagaggggatcagctcttcaaagggcactgggccaggcttcccagcacccagggaccctgagctagccttgtgagtagagcaggggagtctggcaggtagaggatgggaggtaaagggaggcacagagtgggcggaggctgggaagtgtgaaagggcactgtgtacagaacctagggagtaagcagaagccagagatggatggaaagttgggctgggctgcattgtggaaagccttgaatgccatgccaaggaacttgggccagtgtattcaccttggcttgagttgtaaaagcaacaatgcagattcctgggccccaccctgggcctctggatctgaatctggagggagacgctggggaggcagcagggaggaaaacctgcagtcactcaccccagttacaacacatgcagttaccggcaggtccgagataacctaagggtttccaaatgctaggaagtgactcaatgactgatatgtttaatacaatacaatcccggttgcaaaatgcccagggcaagggtgggggtgttcagttttctaatgctcccagttcaaaaaggagctgaaatgaattgtcaaagaagtgacaagctgggcgcagtgactcacacctgtaatcccagcactttgggaggctgagagaggatcgcttgaacccaggagtttgagaccagcctgggcaacatagtgagatcctgttcctacaaaaaaaatttaaaaacttagccaggcgtggtagcaggtgcctctagccccagctatttgggaggctgaggtgggaggatggcttgagcccaggtggtcaaggctgcagtgaactatgattgtgccactgcactgtagcctgggtgacagagcgagactctgtctcaaaataaacaaatacataaatacatgagaagagagaaccttttctacctcccccatctccctgccctcttccacccaccccatctgggacgatggaggagagcgtttgggattagatgccccacctctcgactgccctcactggtacctgggagtgaggccaggacagaagccgcctaagtactgttcttcctcacatttgtaaaagtgaactttcttgagggttgatgacatgttttataagctacttcacacaatgtccaacacccagtgggtccacaatcaatgtatatgtctgttgttacctgtcaaaacgtatagctggggagtgacagtatggacttgagccagatcacccagtgcaaatgctggctttgctgcttactgtgtaactgacttcccagagcctcagtttctgcatttatgagattatagtgactatgccattgtagtgatgactaaatgagttaatatatgtcaagcatacaaaacagtacctggtatgtagtacaaactatgtatttgttaaatgaataccttttttttttttttttagagccatggtctctctctatttcccaggctggagcacagtggcacaatcatagctcactgtagcatccaatacctgggttcaagtaatccttccacctcagcctcctgagtagctgggactacaggtgtgtgccaccacggctggctaattgtttttatatttttagagacaggatcttgctatgttgcctaggctagtcttgaactgctggtctcaagcagtcctcctgcctcagcctcctaaagtgttggatttatagatgcgagcaaacgtgcctggcctaaatgaataaatctttactgttgcctcctttgagctttattggttgggatttagtccactcattttgcaggtgagaactgagacccggagatgaatgcagtagccttgcctcaggtccacatctgagggacagactccatcctacttttcttcccatgtattctttcctgcttgtaccagttcactggggtgaccaagaaagacatttctgagttttcctcctggctggcacagtggagacatgcccagccacgtttagctagacttaccatggctgggctagaagagaggccaggagcttgtctggaggttgcacagacctgcccttggtgaatgtggatcggagcgccccggcagaggcttgaggtgctacagaggctgggggatccactgtcagaccgggtgcatcaccactgttttatgatatccagcaaattgctctgcgtctctgagcttaaggcagagagaagggcctgagcttgaagaggggatcccaggtttaaatcggagctggctacttcccagctctccactgtgtaatctggaggaagttgtttaacctctctgagcctccctttgttttgtcatgggtatttgcagggagagcattcatgagatagtttgtatagacattttgcccttggaaggcgctcagtgattgctgtttttctctgcattttggaccgagtcccttctgcgtatccagcacctggcttcctcctgcatttcttcctcaggaatttattgagcacctatatgtgccagagcatcggaccaagtcctttgctctcctggggtttagattctagttgagcatacaggcaatgtacaaccaatacatatgttcagatcggcagctttatctgttattctgaaatccacgatttctgaaaaccgaaagtttttcataactcattttgaagctaaacttgaggctttttagagtcttcatcctcttcggtgtgatgctcagatgtctttctgcagagatattagtgcaattgatctttgggtgctttcccgccctgcatgatgggcatgtcggtgggtattttatacaaggtgacctttctacagcctgagtcatcctgaattctgaactatgtctggcccccaggattttacaggagagaacatggacctgcaatatcctatcaggtggagactgtgctaggaaggaaagcaaagctgggtgcaagtggaatcagggagggcttccctgaggaggtgacatttgagagggaaatgaggaagagagggccaggtggagggactcacagaggacggaagactccacttcctgactggcctgtgcttacccctcattctgcatgcacagttctgtctaaatgcgtccgttcttgcctttccaagaagtgctgatgtctcttacgtttcaagtctagctctgactgactcattctctctttaggtgcccccacaggcctcctcacctcttctcgtttgcttaagaaatctgaggtctgcgctaaagccagcctgggtgctgtaacctctcggccgaggatggtgcccagctgggcttgcatctggagttggaggaagtgggtcccgggaggggaagaggagccgtggggccttccaagggtttggtggaattgagttcctggtggggaggggctgtgttctgggtcttagagcctctcgcctgcaaagcaaagttgaacgtaacacgcgctcacatatctcgagtgccagcccggggctaggtgcttaacgcttgcttagccaaagtgccaggggctggggacacgggaatgagtgacccagaaatgagggccctcatggagctgaaagcattctgggcttggtgactttgaggaagtggcttttgaactgagacctgaaataccaaggcatgtggatatctggggaaagagtgatcctggcagtgggaacagagagtgcaaaggcccagaggcatgaatgagcttggtgtgtttgacccacagcaaggaagctggtgtggttggatggaaccaaacaagaaagaggtctaggagcagaggtcagggagggagctggggccagatacctgcattgtctcatttaacttgtgtaataaccctaccagataggagctactctcatgcaaatgttacagatgaagtaacagaggcacagagaggttcagtgacttgtccagggtcacacacctgaaggtggcagagcagggctgtgaacctagaagctccagagtcctcagtcctcaccatggtgtttaaacacaataaaatctatgcctgagtgctgaagacacacctgccatttagatcgatccacttttttacattgtcggtgtactccctgccatccatctgcccagaaatactgtgaatgtgggcagcgcaggactggttcctccaagccccattttacagacagtccaatcattttacatattattttatgaatgagcaccttcctcagtgtctcagaccaggggtccccacacagcagggccacacagcaggaggtgagtggcaggtgagtgagcgaagttttatctgtatttacagctgctccccatcgctcgcattaccacccaagctcggccacctgtcaggtcagctgaggcattagatgattctcacaggagcacaaacccttttgtgaactgcacatgtgagggatctgggttgcgtactttttcttttttttttaagacggagtttcgctcttgtcgcccagactggagtgcaatggtgcgatcttggctcactgcaatctccacctccccatgttcaagtgattctcctgcctcagcctggtggctgggattacaggcctgtgctatcacacccagctaatttttgtatttttagtagagacagggtttcactgtgttggccaggctggtgtcgaactcctggcctcaggtgatccacctgcctcagtctcccaaagtgctgggattacaggcatgagccactgcacgcggccctgggtgcgtgcttcttatgagactctaatgcctgatgatctgtcactgtctcccatcgcccttggatgggaccatctaattgcaggaaaataagctcagggctcccactgattctgcattatggtgagttgtataattatttcattatatgttaccatataataataatagaaataaagtacgtaatacatgtaatgtgcttgaatcatcccgaagccatggccccaaccacggcctctggcagtggaggctggagtccacatcacgctctgtgctgggtgcaggaatggagatgagtgggtgtcctgctcatttccctgaggaggaacctgaggctcaggctagagacttacctgggtgacacggctcctaagtggcagagtccagattcaaacccagggctacagacccagaagcctgtgcatttaaccacggttctgagctatccagcccaaagaggagagtttaaaaggattacatttcttcgttggaaatcagtgagcatagtcgcccagaaccatttttgaaaaactcagagaaggcctatgttttcctgaagcggccagggaagtattctgcctttttaaaagggaagactgaattctagggaggagaggcaccagctctctgggctgggcaggtctccaagctggcagggccacagcctcccgacggtcttgcctctagcatatttcttccagaagccacatttccacaggtgggcagctctaactgggagaaaatcttcctgagatttagccaaattagctttctttctttctttttttttttttgagatggagtctcactctgctgcccaggctggagtgcagtggcgcaatctcggctcactgcaatctctgcctcccgggttcaagtgattctcctgcctcaacctcccgagtagctgggatttcaggcacacaccaccacgcctggctaatttttgtatttttattagcaatggggtttcaccatgctggccagactggtctcaaactcctgacctagggtgatccgcccacctcagcctcccaaagtgctggtattacaggtgtgagccaccgtgcccagcccaaattagctttctaggagcttccactttctgagtctgtttctgcctcttggaggtagtgaccatctccctccaaactcggatacttctcttattcagactacacaactgtagttatttcaggtattctccctgactcaggaaattataagtttggcctgccttggcacatgagtcaactggttggagtcccacgcaaagactgtttgtttggtcaaagaggaaggagactattacctccttggatctagagcttatacttctgttgatgcaacctggaatcatactgtgtagcagccatatcccacttggagtgcatattgggcttgtcagctaaaatctccatgtttctcttctatatgagctgctgttaatccaagtttcttctattctgagagtccttgtctaaagctaagaggttccagtttttcatgctctctaataaatctacttcaggctaacatgctatcattttttctttgagtactgctttggtttctttccacaacttgttacacaatgttattcactgcccagtttagaatttcccttttggttcccattttaagacttatttaattatatgctttttaaatttttgagacagatagaattttttaagttatctttttattgttgatttctaaatttggtcatcatggttgttgtggtcaatatatgtggttcctataatatcagtggtagagaatttgctgagatctttataggattttctggtcatttttttcctcttgtgtttgaaaagaatgtatattttctgttgggtataaggttctagaaatgtatctatttgatcaagctagctattatattatctatatttgttatgtcactatgtggttttttttttttttacctgatttacctcccaccgtaatacaattacaattcaccataatagaggctttgttaagttctccttttgagtctgtcagttttttgctttatttttgaagctatgttgttaagtgcatagccatatgagtagaataagggttcaggatttttatacctttttggtgaattgttgcattttcccgagtagctgggactacagatgtgcactaccacgcctagctgatgtttgtgttttttgtagagatgggatttcgctatgtttcccgggccagtctcaaactcctaggttcaagcagtctgcccacctcagcctcccaaagtgctgggattacaggcatgagccaccgcagctggctgaattgttcctttaatcagtataaaagagccaacttccagcctgggcagcatagtgagaccccatctctaccaaaaactaaaaattagctgggtgtggtggcgtgcacctgtagttccagctacttgggagggcgaggtgggagaatcacttgagaccaggaattcaaggccgcagtgagctatgattgctccactgcactccagtctaggtgacagagtgagacattctcaaaaaaacaaaaacaaaaaaaccatccaccttctctcttctaatacttactcaagacatcattgtcatgaattctattttattgatgtcagtactcctgtactaataagccagatgagttaaaaacaacagcagccttgcaaccagccatgaagcaagtgatcttattctcatttcacagatgaggagactgaggctctgagtggactccagcctgccacggtctcccaccgagtcaggttggagcctgcacttaggcccagagttatgcttctgtgtctcagatgcttgggggtccctgcccacaaaggtggcccccatgtctgtgtgtccccacccatccaggaatggtatggggtgagacaacaggaagagctccatgggtagtccccacccactgccttccatatgccagtctgcaagcagaaaatgaacgggaagctcttacctgtgcccatgtgttgtcctggctttgggtttgcccagggggcaaagtcctggtcattgttgagacaagttcactgctgctgagggccgagcaaatggtgacaaaggccagattctaaattcctacctggttacttcctgctccgtcaccatcacctcgggcaaattctgaacctccctcagcctcattcctccatctgtgcttgcagggagaatattttactgtatcttccatagtgagctttccaggagaagcaaaaaagagtggtgtataaaaaagcaagtttatgactgcttctgtgccaggcactgtgctgtgcactccagagccaaaggcctgggttcaaatcccagcccactcactagctgtgcatccttaggcaggttcctgaccctctctgggcctcggcttctccatctctgcaatggagatgatattaattgtatctgcaatgctccttggattgggtccatggttaagtgagtgagtgaggctcaagggcttctttttttttttttagagatagggtctcactctgttgcccaggctggagtgcagtggcatgatcacagttcactgcagctgcgacctcgtgggctcaagccatcctcctgcctcatctcccttagtagctgggactacaggcatgtgccaccatgcctggcaatttttttttgtatttttggtagagacggggtcttgccatgttacccaggctggtcttgaactcctggactcaagtgatctacctgcctcagcctcccaaatggctgtgattacaggtaggagccaccgcgcccagccttcaagtgcttttttttgttagtgagactggtacaaccaatgccaaggctggtgagcaaagttgcacccagttggggaggggcgaaaccaagggcagaagggcccagggcatggcctctcatggctgaaggaagaggggacacgtggccagtcacagtgacctctgcagacctcaagaaggaggccagctaggagccatagctgtcactaagacagtcaaaatctaatcagcaccctggcgccaagaggccattgtccgctgctcaggacagtgagtgatagtcgataaccagctctctggaggtcagggccccgaggtggctgagatctgtgcctgcattaggacatttaaggggactccaagccaggatttgctagtgtttgcccagcagggagaggtggaaaattggggatgaccaaccaggcctccctgctcacagccaggggaattcatcctgtcgttcttccattcagcaaatattcatggagcacctgctgtgtgccaggcaccgtgctaggctctggggagatggctgtgagcgggatcgacactggccttgtgtgagctggccttgcagtaggggatatgagcaccaaacacataaggcccgagtgtgcaatatgccacaaagattgcagagaaataaagcaagataacaggttgcagaaagatggaggccaggctggctgctgttcctgggtaggtggcttctggacacagtttcctcaggctctgtttcctcctttgggcctctggaatcttctgaagacaggcctggcttccaggatcccggatggagttgcctgttgactgtgtggactcaaagtgtccacagtgcgccggagcgcgtggtcttccccagcaaatctgcttctcttctcggctctccatcgtgggaagggtccctgggatcctccccaccaccccagcctgaggccactttccctctgtccccgctctccccagcctgctttccccaccaagcgccaccaagtccctgctgcctcctcctcccaaacaggctcaaacctgccccctcttcgccagctctcagctcagcccgctcctctcctgcttaagagccttcactggctccccactgccctagagacagagtttgagtctactgccatggcttggcagacgatgttgtccctggcctgccaaccttccagctgccatcccagccagtccttctcccccttgctccagccaagggccccgcttgtagggtgggaagtgggccgtgccctccctcctgcctgcctattcgctgggtcttccctcattccctccctcaccccgccctctcataagaaccttcagaatctgccagacgcagtggctcacgcctgtaatcccagcactttgggaggctgaggtgggtggatcacctgaggtcaggagtttgagaccagcttggccaacatggcaaaaccctgtgtctgctaaaaatacaaaaaaattagctgggcgttgttgtgggcacctgtagtcccagctactcgggagactgaggcaggagaactacttgaacctgggagacagaggttgcagtgaactgagatcccaccattgcactccagcctggactacacagtgagactctgtctcaaaaaaaaaaaaagaaccttcagaatcataaaatgggtttaataattatacttatctcatagggagggcttaaagcacctaggccagtgtctggcaccaaggaaacactgtatacctgttaaaataagaataaaataaaatacacatgctcacttattgagtgcctgctgtatgtcgggcccctccccgagagaactctggtgcatccccgataaagaaacctgaccctctaggatgagggagggtcttccctgagcgcctgctaacagcctcctctgctaatctgaagtcctgcagcttgcccagcaggctggcttgtcacacgggctacccccacaggccgccatcttggaaaaggccaatggctgtggaatcattcttgactcctattagccttcctgttctctctcccgccccacagcatccatcctgtcagcaaatcctgtgggctctgtcttcaacacagatctagaattcagccccttctcaacctccccatctccgcagcctggtgtgagccctggcacctctctctggggccagtgtggtagcctcctcactgctacccacttctacccgtgcccccaccacccaagcaagagaggtcttttttaaagtctcatcatgtcacttctttgctcaaaacgctctggcaacttcttccttgctcaaatatttgttaaaagaagaaaggaatgaatgaatgaatggcctgtttgcatctgtaatagccagcacataggcagtacttggaaaacacccacagcaagaataaatgaggagatggctggacacggcagctcatgcctgtagcatgttggaaggccgaggcaggaggtttgcttgaggccaggagtttgaggttgcagtgagctatgattgtgccatagcactccagcttgggccacagagagagatccccatctctacaaaaatttaaaaattattcgagcatggtggtgtgtgcctgtagtcacaactacttgggaggctaaggcaggaggatcacttgagcccaggagttcaaggctgcactgagccgtgacggtgcgactgcattctagccacagaatgagaccctgtctctaaagcaaaaaagagaaggagaataagtgaggtacttgagcaagtgggtgaggatggttgagccacagcaggcccacagggaggctggtgggtgctgttggtggagggggccgatttgtgttcctggtggctgcagagccagtctgttgcctcccctccctcccactggctgggctggggacggagccaaccaggcagatcccgggccattctggggccctggcctggcctgccttactatcccagtggggccaccgacgtggctgccatttctggaaaccccagttctaggtaggttactgtcccaggaagaagtgcatgcctagcttcctgccagcccagcccagctgtcccagaagccagaggaagctctgggctggtttcttataagtagcatgactaactgattgcgccacaggagctgaggtttcaggccagtttctgtcgtggagtttcaggggtcagcggctccaaagccccagcccccacccgaggcccctgctgtccctggattcctctccacatgccacctgtcacagaggtgcttgcatcctgtctgcagaaccagcccctcctccaagccaggtttcctgcccagagggaagaagagcagaaggcctgtaccgccccctgtgcgcccccagtcctccgccccctgcccccctgccacccgctgtgggttcgggaagagtcctgctgggtcgcttccaggctgctgctggcttctgacatttcaaggcttaatcacttaatctcccccgagttttttaaaaaaagtgagtcaagtgtgttctcctggtggcgggcgtgttttcccaggcccatgcttctgctcatttcctggctgcggccttcactgactttgctgcttcctaactctgtgaccttggccttgtcacttgctgtctctgggtctcaggccaatgggtctcaggccagtggggctccccggacaaagttccagggttttggggactgcatttcaagggtcagcaaccacagtccttaaacacgtggattttggagtgacaatgcctaggttatggttctgtgaccaccagcaagtgctctagcctttttgtgcctcagtcttctcatcagtaaaatgggaatgttaatggcacctacctcatagggtcgttgggagaaccaaattgattaatatattgtaagtacttagaacagggccaggcacaaaataagtactgcatatacagttaactatggacaaaagcttgggacctggttcatgtttaaaaatgattattgaggccaggtgcggtagctcatgcctgtaatcccagcactatgggaggctgaggcaggcggatcaggaggtcaagagatcgagaccatcctggccaacatggtgaaatcccgtttctactaaaaatacaaaaattagccaggtgtgatggcgtgctcctgtagtcccagctactcaggaggctgaggcaggagaatcacttgaacccacgcggaggttgcagtgagctgatatcgtgccactgcactccagactggtgacaaagctaggctccatctcaaaaaaaaaaaaaaaaaagattgttgaatttattattgctgaatttttttttttttgagacagaactttgctctattgcccgggctggagtgcaatggtgtgatctcaactcattgcagcctctgcctcttgggttcaagcgattctcctgcctcagcctctcagcctcccgagtagctgggaatacaggcacccaccatcatgcccggctaatttttgtatttttgtagagatggggtttcaccatgttggtgaactcctgacctcaggtgatccacctgcctcggcctcccaaagtgctgggattacaggcgtgagccactgtgcccagcctattattgctgacttttaaaccattcattcatttaatatatgtttattgtacacatgctatgcctgtgtcaggcactgtttcaggcactggggataaagcagtgagcacagcagacataaagctctgccctcatggggcttgtggtctctcagagggaggcaaacaatgcatttatagacaaatacataatttaaatttgaggttacctattatactcccaacttgaaaaactagcagtatattgaggtggctatttcacatctgatggaggaatatgtcttttgtgaaccatttatgttctttgcctatttttcttaaagggatgtttgtcttattgatttgtaagaactcttcatatattaaggccattaaccgttcataatgtagattgctacctttttctagtcttttgcttgctgatatagttgggatgtcatcctctctaaatctcttgttgaaatgtgatccccagtgttggaggtgggtcctggtgggagatgttgggtcatggggacgggtccctcatggtttggttctgtccttgccatagtgagtgagttctcacaagatctggttgtttagaagtgtgcggcacctccctcctctctcttgccctggctgtcaccatgtacgcctgctcccctcttgccttccccgtgaataaaagctccctgaggcctccccagaagccaagtagatacgggtgctatgcttcctgtacagcctgcagagccataagccaattaaacctcttttctttgtaaattactcagtctcagatatttctttatagcaatgcaaaaatggactaacacacttgagttctgtctttttcttatggcatattttaatctaggccagacacagtggctcatgcctgtaatcccagcactttggaggccaaggcgggtggatcacttgaggtcaggagtttaagaccagcctggccaacatggggaaaccctgtctctactaaaaacacaaaaaattagttgggtgtggtggcacacacctgtaattccagctactcgagaggctgagacacaagaatcgcttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgattagagatagtgataagtactgggacagacataaacagggtgctgtgataagaagtcacagggagggcccgcattagttgaggggggtcagagaaggcttctgaagtgtttctggtgcaaatgcttggaaaagggagagctgggagtgtatcccagggctgaggccaatggaggattgcagaagagggagaggggataggaggggaatgttagagggataagcaggggaattggctcttttcttcattttcttaaattaaactttttattttcagataattaaagatttacacacagctggaagaaatcatagagaagccgggcgtggtggctcatgcctataatcccagcacttttggaggctgaggcgggcagatcacttgagatcaggagttcgagaccagcctggtcagtatgatgaaaccccatctctactaaaaatacaaaaattagttgggcatggtggcttgcctgtagtcccagctactggggaggctgaggcaggagaatcacttgagcctaggaggtagaggttgcagtgagccgagatcacaccactgcactccagcctgggcaacagagtgagactccatctcaaaaaaaaaaaaaagaaaagaaaaagaaaaagaaatcacagagagacccctgcttctatgctgttccccccgagggcaagattgtagaaatctgtaatacagtatcacagctgggatactgacactgatataagctactgaccttattgggatttcccgatttacttgtactcatttttgtgtttgcgtacgcatgtgtggtttagtgctatgcaattttatcacggcataggtttgtgtatgcagccaggatccagcacagttctatcatcacaaggatggctcaaattctccttttatagccacatccaactcccttcctgacccaccccctcagcccctggcacccactgatgtgttttccatttccatggttatgtgatttcaagtatgttacataaatggagtcacggggtgtgtactctgggaactggcttttttcactctagggcttggattttattctaagtcagagatgcttctctaatgagctgtgaaccccctggggatctgtggcccctgtgaagaagccctttaggagccagggggcattggatgtgtgagctggccctggtctcatttctgattttaaaatggctctggctgtgatgtggagaagaggcagggtgagcctcatctgcagcaactgctaactgcccacatccccccagacttctcaaaaatttgccactcccctgctcaaagaccctcaaaagctgcccactgcttagaggacaggcctttgacctgaggtcctcacttgggcttcagggattctgtgaacccctaaaatggaatgcagaattaagtgtatgcaccttgccagaaacagggtttggggtttacattagatgctcagataggtcattgatccccaaaacactaaggtctctgacttctagacagatagtagttaagaaccaaagctttggagcttgagtgctggatttaagacccatgactgtcacagctgtgcaacctcagacaaatcactcagcctttctgtgccttggtttcctcatctgaaaatggagaaaataatattacctatttcatagattattaaatgcattcttgtatgtaaaagatgtaaaagaaaacttggcatgtggtaaactctgtgtgtttaagtgaatggtgaggctgcccagtataggagggcagagctttccaggtaaagactttctaggcctcctgggattatcaggccctctctgtgttggttgttgtcatacatgacagcagtattccttccaaagggatgccaagttgtggttgcacactgcacttagatccagttgattgacagcactgttcaagtcaactgtgtccttactgatttctgcctgctggatctgtcgattaccaaaagagttgaagtaatagtaataatactattattatccaataatagtattattcagaataatcacacagatttctctatttctccttgctgctctcagtttttgccttacatattttgaccctttgttgttagttgcctacacattaaggattgttatttacatcttcttggagaattaactcccgaatcattatatagtgccacttttttttaatttaaaaattttattttttattttttgagacaggatctttctctgttgcccaggctggagttcagtggcatgaacacagcccactgcagccttaacctcctgggctcaagtgatcctcctgcctcagccttcccagtagctggggctacaggcatgtgccacctctaataacttttctttaatttacaatagtattagtttgttctcatgctgctctaaggacatgcccaagactgggtaatttataaaggaaagaggtttgactcacagttctgcagggctggggaggcttcaggaaacatattatcatggcggaaagggaagcaaagacatcctttttcacatgacgtcaggaaggagacacgccaaggaaagggggggaaagccctttataaaaccatcagatctcaggagaactcactcactgtcacgaaaacagcatgggggaactgctcccgtaatctaatcacctcccatgaggtccttcccccaacacgtggggattacaattcatattacaattcaaggtgagatttgggtggggacacagagccaggccatatcacattattattaattagtgccttctctctcatttttttgattcgcctaggtagagatttatcaatttcattgatcttttcgaagaaccaatttttgatttcattgattttcctcgattaattttctatttttaatttcattgatgtatgctccaattttgtatttttttcttctgcttgttttagacatatattgcttttctgtttctagtactctagatggaaacagattattgattttagaactttctttctaagatatacattcaataatataaatttccctctaagcactgcttttgctacgtctcaccgattttgataggctatattttcatttttatttagttaaaaatatttttagtttctcttgtgatttcttctttgatccatatgttattcggaagtgtgtttttaaatctccaaatacttggaaattttctggctttcttcctgctagtgacttctaatttgaatccattgtggcctaagagcatatgttgtgtgatttctaatgttttcaatctcttaaggttgttttatgtcccagaatgtggtctgtcttggtgattattccacatgaacctgaggagaatgtatattctgctgttgtgagatgtaacagtctataaatggatacctctgttaatatgacctcgggtgactctttttttttttttaagttgctgcttcaccattggcttttggagattttgcagatgataaaatcctcaggacttttctgctgctcagtcagattttcttatcctacacttgcggaactgttgtttgaaattgacaagcaggatggccaactctgcccggctcattttatttcatcttattgggttcagcctgcagttttaggagatgagattgaaggaactggtatactggaatccacggtgggctcggaagcaaacaaacgtgggttctgattctagctctgaccttttaccagctgtgggacctggtggatgggttatttggcctctctggcctcagtttccttagctagacagttgggataacagcctacctttcaggattcttgtgtggattcggtgaggtaatacttctaaagcacctagcaaagtgtcaagtacaaggtaagtgctgggcaagcagggattttgttcacacaaagccttgactcaacataaggaggctgtttccaatggctctgcttaactgagacctgagagtgattgctccatctgtggtggcatatgggctgaaactgcctagcagcatgtcagaagtggggtgttcgcaggacatccttgtccaggttggcagttgagcttggcaggtgaccgctgagaccccttccaactccaccacttcaggaatctcttttttttttttctgagacagtcttgctctgtcacccaggctggagtgcagtggctcaatcttggctcactgcaagctccgcctcccgggttcaagccattctcctgcctcagcctcctgagtagctgggactacaggcacccgccaccacgcccagctaattttttgtatttttagtagagactgagtttcaccatgttagccaggatggtctcgatctcctgacctcatgatctgcctgcctcagcctcccgaagtgctgggattacaggcgtgagccaccgcgcccagccaggagtctcttgatttagaatgggaacttgaaatcatctcctcttgccgtgtacttgaacgcgataacctggcacttatctttttaattcttttactcacctgcatctttgttctttttgcctctgatgttcagggaagcctcttctcccactgcatctgtgatctctcctgaaatgtagcacccacacatccctgagaagctagctgcggcacgtgtgtgtgcacatgggcatgcgtaagtctgggcgtgccttccacaacagattaaggatatcaatcctgacgccatgctgggatgttttagtgaatcttgacagggttgttgactcccctgtttccctggaggactttaccatgaaagtcttctgctgtgtgactttggacaggcgtcttggcctctctgtttctctttattcataattgaggctaaagtgacacctttgccatctctgccacaggatactgtgggcatctgtgtagttgtgagagtaaaagttactaggacttgccaaggaaatcagtgtcaggaacccaccaccccattcccgcccctcctttacttgagactttacttttgtaactctcagcaaggaagacgagttcaacctttgagccgatacagagccttcccctagagagagctttgcagcctcatgctgagccagttaggggccccacatcatgtccaaaatgaatttaatcaacaaacagttactgaacacgtcctatgtgccaggcaccgttgtagatactggggactcggcagtgaatgggacagaccctggctgtcaggatgacagacaatttaaaaagggacagatgtcccacgctggcttgtcctttgcacccccggcacttcgtgaggagcagcggccagttcttgtatatagactggcccttggtgtacatttgtctgacgtttccaaatgatgtatgcatccttggcaggaacccaggaaaagacatgctgtgctcttctcaggaattgtttcagggaggtgatgttggggatttgtcccattcttgttggtgagtttagatcacttggtgaaggtggtgtctgccaggtttctgtattgtaacgttcattgatatgtattttcactcattagttaatatacaatacaagttttgcagggagttactttgaggctgtcatagtaaaatagagctttcccttcttccctgtttatttatttattagagatgaagtctgactctgttgcccaggctggagtgcggtggtgcgatcatagctcactgcagcctccaactcccaggctcaagccatcctcctgcctcagcctcccaagaagttgggattacaggcacacaccacactgcacccggcctcctccatttattgatctatgtcaatacagactcctggactttaactccaagggttacaagtggataccataatattcattttgatgctcaaaatgtgcctgttttgtccaggtcaggctagctgctgagtacttccttattgtctggcacaagaattccaagcctatctggtacttttccttctcctggaatcagctatttctctaaggcgctctggttcctttcagtacagaatagtatttagaagccaagacctggtcactaggaaggcatgataatcaaatgtgatgaatgatcttggattgcatcctggacgtataaagggcattattgaggcaattagcaaaacataaataggggccgtggatgagatagtggtgatgcatcactgttaatttcctgatttcgatggttgtattgtgattatgcagagaatgtccttgtttttctgacatgcacactgaggtattggggtaatttattcattatggagatatgtgagtgtgtttatgtgtctcatacacagatgtttcttaatgatggggttttgtccccataaactcatcataagttgaaaatattattaagtcagaaatgtacttcatactcctaacctactgaacgttatagcttaacttagctcggaacacttgcattagcctacagttgggcaaagtcatctaacacaaagcctgttttgttataaagtgttgaatagcttgtgtagtttatggaatactgagagtgaaaaacagaatggtcgtatgggtgctccaagtactgcttctactgaacacccattgattttgcaccatcataaattaggggaagagaggaaaagcacgcgtaagggaggaagggccgggtacagtggctcacgcctgtaatcccagcactttgggagaccaaggtgggcagatcgcttgaactcaggagttcgagaccagcctgggcaacataatgagaccccatctctatcaaaaatacaaacacttagccaggcctcatggtgcacatctgtggtcccagctactcaggaggctgaggtgggaagattgcttgagcccgggaggtggaggttgcagggagtcgaggttgtgccactacactctagcttgggtaacagagtaaactctgtctcaaaaaaaaaaaaaaaaaaaaggaaagggaggaagggaaggtccctccaggtggaggggacagagagagaaaaggcatggaggtgggactgagtttggtgtgtttaagaagtgcaggtggcagccgggctcagtggctcacgcctgtaatcccagcactttgggaggctgaggcaggcggatcacctggggtcgggagttcaagaccagcctgaccagcatggagaaaccctgtctctactaaaaatacaaaattagttgggtgtgtggcccatgcctgtaatcccagctactcagaaggctgaggcaggagaatcgcttgaacctgggaggcggaggttgcagtgagccgagatcgcgccattgcactccagcctgggcaacaagagtgaaactctgtctcaaaaaaataaaatgaaataaaataaaataaaatgttaaaaaacaaaaaagaagaagtgtaggtggcaggcgtaggatgcatgggtgctgggcccaggtggagagggaggtggagccctgctggggggagggccttcaagtgtgcccaagtcactcggagagcatccagcaggggcctagagctcctgaggtggccttaagttcttatgatgccccagacactgcacacagtgcttcagaggcaacacctccgttcctgtttgctgcaagcctgtgaggttagccttggaaccattcctgtgccacagaaacacagccagagcaccaaaagagaaatgctgttaatggcaaagaactactcactagcagaacaaagcctgggagctgcttttttgaataagatcccaggagagagacccaagcgggaagtgaaggatgggcacttgaaatgttgcagggaatataacccagcgcgtgctgttttctttttttctttttcttttttttttttttctctttttgcaacagggtctcactgtgtcgcccagcctagagtgcagtggtgccatctcggctcaccacaacctccacctcctaggctcaagcgattttcctgcctcagcctcctgagtagctgggactacaggcacgcgccactaccgcccggctaatttttttttgtatttttggtagagacaggtttcaccatgttggccaggctggttgtgaactcctaaagtgctgggattacagatgtgagccaccacgcccggccccagtacacactttttggagggtatttgacgttatgtaccaggagtgctggggaaaagtacacacttgactccgtgagattctgcttcttagcatttttttcttttcctttttttttttttttgagacagagtctcactctgtcacccaggctggagtgcaatggcatggtctcggctcgctgcaacctccgcctcctgggttcaagcaattctcccacctcggcctcccgtgtagctgggactacaggtgtgcgccaccacactcggctaatttttgtatttttagtagagacagggtttcactatgttggccaggctggtctcaaactcctgacctcgtgatccgcccacctcagcctcccaaactttctgttttcttttcttttcttttttttttatgacagggtcttgctggagtgcagtggtacggtcttggcttactgcagccttgacatcccaggctcaaacgatcttcccacctcaacctcccaagtagctaggattacaggcatgcaccaccgtgcctggctgattttgtttaatttttgtagagataaggtctcactctgttgcccaggctggtcttgaactcctgggctcaagccatcctccctccttagcctcccaaagtgctgggattacaggtgtgagccaccacacctggcttctgaacattttttcttaatgataatagctggtgctatgggctgaatgtgttcccccaaattcatatgttgaaacttcatcccattgtagtcatattaagagatggggcctttggagaagtgattaagtcatgagggctctgtggttggtcatgaatggggttagtgcccttatgaacgggctgaaggaagtgtgtttgccccttctgtcatatgaagacacagcagcatggcatcgtccgtgaggaatgggctctcaccagatctggatctcctagtgtcgtgatcttggacttcccagtctccagaactatgcattagaaaatttatttatttattatttatttattttgagatggagtcttgctcttgtcgcccaggctggagtacaatgacgcgatctcgactcactgcaacctctgcctaccccagttcaagcgattctcctgcctcagcctccagagtagctggaattacaggtgcccgccaccacactcggctagtttttgtatttttagtacagacggggtttctccatgttggccaggctgatctcgaactcctgacctcaggtgatccacccaccttggctccccaaagtgctggaaatacaggtgtgagctactgtgtctggcctgaataataaaatttaaaacaatttttcaaaaattcaccatgaggtctcactatattccctaggctggtctcaaacccctggactccaagtgatccaccccaccttcccgagtagctgggactagagatgcacaccattgcacccaatagagcaatacgtttctgttctttgtaaattacctgctctaaggtatttttgttatagcagcctatatggactaagctgacttgtaacgttacttgagactttaaagtgttccggtcactgttggagggctctgtctgtgttagctcatttaatccccacaacacctcaatcagatggggctattcttagtcccactttatagataaggaaactgaggcatggaagcacagcttgctcaaggttcacatctagtcagtgacagagcaggtatttaaacctcaggaaataatcagagaaacatgtgtagagggttgtccaaggaaggccacatccagaagcatctcccaggacagttgttgtgtagctcaccctctggactttgtgggtctgggtgttgtttcatgattatagagagagctctgtgaacgtggaggacctgttgtcggcagagacacaaatggccagggcatggctgggcagccgcagtggctcaggcctgtaatcccagcacttcgagaagaccagaggggcagatcatgaggtcagaagttcaagaccagcctggccaacatggtgaaaccccgtctctactaaaaatacaaaaattagccaggtgtggtggtgggcacctgtaatcccagctactcgggaggctgaggcagaagaatcgcttgaacccgggaggtggaggttgcagtgagctgagattgcaccgctgcactccagccttggagacagagcgagactctgtctcggaaaaacaaacaaacaagcaaacaaacaaacaaataaatggccagggcaggggagggttgcatattgaataagatgagctctgctggaagcacaggtcagcactaacctgcttcctctctctctgcaggtgccttggcatctcccaatggggtggctttgctctgggctcctgttccctgtgagctgcctggtcctgctgcaggtggcaagctctggtaagtcaccacttctcaatcattcatttgttggctattaatggcgtgccagggtcctgcagtatgtcacctggccttatggagattacactgcagtgggaggggacagccaatgacaagtggccctgattatcagtaaattctaaagattgttagaaagtgatgggagccgggtgcagtggctcacacctgtaatcccagcacttcaggaggccgaggcaggaggatcgcttgagcccaggagttcgaggtcagcttgggcaacatagggagaccttgtctctacaaataataaaatattagccaggtgtggcagtgcacgcctgtagccccagctactcaggaggccgaggtgggaggatcccttgaactcaggaggtcaaggctgcagtgaactgtgatcgcgccactccactccagcctgcgtgagaaagtgagaccctgtcaaaaaaaaagagaaggtgatggggaaagaacacagaacagcataagagggggttggggaagctgggtggagtgggggggattgcagttgaaagtagggaagtcagggaaggcctcattgagctgacttggaggaagcgggaaccgtgcagatgtctggggaaggctcattcttggcagagaggccctgcactgagcctggcgggagggttgagcacaggagggaatgtggtggaggagagtgagcagcaggagggagcagtgaaggtcagcaaggtgacagagtggctgaatcaaaaaagaccttgcagtgtttgagcagaggatccatatcatccattatgttccaaaggactcttcaggatgccgtgtggagaaaggaagagggtggaagccaggaggtctggagggaggtctggagtggaggagatgagaggctccggatccctctgggaggtagatttgaggacagattggaattgaggtgaaagacagagaaagagaagtggccaggatgactccaagatttctgacctaaactactgggaaggacgcggttgtcatttctgaaatgcagaaggatgccagaagagaaggtactttggggaggggcgggaatcaggagttagttttggacatgagataagcttggaatatttatttgctatctaagacagctccttaacatggtaagcccttatgcaagttgttgtcagctgagatgggcgtggcactgagcatgggagcatggaggcgcctgagtggtctcatgctcaggtggtttagcaaactcagtgtacatcctgccaattccagtcctgccatggccactgacaagctaggagggcgctgaaaggagaaggaccccgatgtctcctccagcccatccatctcctctctcccattggccaaacccaaccggaaactaaaggccaagggtacccggtgatgaagactgtggtatcagcctcctgagcacagagagggcagaaaggggtggagacaaagaggggcgcagatagtgggcaaatggggaagtggcacttcccctagctcgagggcagaggcttggtgtgatggaatggcactccttaaactgctacatattttccctttaatttggccaagaacaagttgtcaagtttgtgtgagataaaggtgcacttggttcgttcttgtctaatggcccccgcacccatgggtatttcttcagcttccacagtcatcccgacactagctgggaagctccagcagccctggtcctggccccagctctgtgggcgctggccctcaactttgcctgcactgtgcttttgtgctattccccttggtcctgtttgggtgcaagtccccctcacgcattgagttcctgggccgctcaggctgctcctgtgtctccccagggaacatgaaggtcttgcaggagcccacctgcgtctccgactacatgagcatctctacttgcgagtggaagatgaatggtcccaccaattgcagcaccgagctccgcctgttgtaccagctggtttttctgctctccgagtaagcctgcgctggagctggaggtttggggaggttgtgcccaaagggtttgccccaagagtgagctgggtccaggtggtgcgctggagtgcaggatgctgagtatggtttgctgctgtttatatggtgttagaggggaggtcccatctccagggacatgttatgtaagatacagtggagcgcatggtgggagtgttggtccacgtggcacatggatacggctggaatactggactagaccagcagttctcacactttttggtctcaggaccctttttcacacttaaaaatgagtgaggacccaaagggctttggtgtaggtaacacatcattctatgtttacctaattagaacttgcaatgaagaaatggtgtaatttttaaaaaattaaaacaattaaaaattttttttcttactgaaatggaggtctcactgtgttgcccaggctgctctcaaactcctgggctccagtgatcctcctgcctccgcctcccaaagtgctgggattacaagcgtgagccgctgtatccggcccaaaatggagaaattttaagtcccaacaacatgcaagcccgcattcaacaaatcttcagatcaattacatgatcacaggtcatgtagcctctagaaaattccactgtacgccagtgagagagagtgaaaaggcaaataacgtccctgtattatgatgaaaagagttttacctggtgggcccagaccacactttgagaaccactggactagacccttgattgaggagtacggtgttgagagtggagtcctctgtgatggtggatggaccaggacacatggcataggagtcaggtggttccctgggctactccatggtgcacaggatgcttcgttacactggtgcccaggacataatcacgtacacaagacacacagttacggggcagactggggatatacggcacaccagcatgcagggttcaccagtaaaggtggtattccatgattattctaaggtagatgggctgtgctttgtttccattggcttagtccagggattggcaaactatggcccgtgagccaaatccggcccactgcttgtttttgtaaataaagttttattggaacacactggctgctgtagttgtaacagaaactgcatggccctcctttatgttttttgtttgtttgtttgtttgtttgttttctttgagacagagtttcgctcttgttgcccaggctggagtgcagtggcacaatctcggctcactgcaacctctgcctcccgggttcaagcgattctcctgtctcagcctcccgagtagttgggattaatggtgcctgccaccacacccggctaatttttcgtatttttagtagagaccggttttcatcatgttggccaagctggtctcgaactcctgaactcaggtgatccacccgcctcagcgtcccaaagtgctgggattacaggcatgagccactgagcccggcctcctcctttatcttaattgaaataattcagaaatggaaagtcaaatactgcatgttctcacttataagtaagagttaaataatgtgtacacatgggcattattccatgtaccatggaataacagacattgaagacttgggagggtgggagaggggtgaaggaagagaagttacttaatgggcatagtgtacaccatttgggtgacggacccaccagaaccccagacttcaccactaggcagcatatccagtgagaacagatctgaggcttgccatcaaaattgcacttgtaaggccgggcactgtggtggctcgcggctgtaatcccagccctttgggaggccgaggtgggcagatcacttgaggtcaggagttcgagaccggcctggccaacatggtgaagctccatctctactaaaaatacaacaattaactgggtgtagtggcgcacacctgtaatcccagctactagggaggctgaggcgggagaattgcttgagcccaggaggtggaggttgcagtgagccgagatcacatcactgtactctagcctgggtgacagtgagactttgtctcaggaaaaaaaaacaaaaacaaaaaacaaaaaactcgtaccccctaaatttatacaaataaccaaaaaaaaaaaaaaaaaaggaaattgtgtggcctttgaagtccaaaatattaactatctggcctgttacagaaaaagtttgcagacccctggcctagcccgtgagatgtgggttggctgttaaggtggaacattggaattatcttacgatggccaaactgtgcgatgcagagcttatgttgttctaaattaattagtgccaccggttcttccctttcatgggctttcaggaacaagctaagtcccaggaccagggccggcagctaggcaggtgtgaggagcatccttggtgcatgtggtaagaggctgtggccagcaagagaggcaaccctagtcggctgccccagcacaccctggccgctcccaagcccccagatctgtcctcacatccgtgatcgggaagctggaagagtctgatgcggttcctggaggcatgtcccggacacagctgtggggcccagccagcctacaggtgaccagcctaacccagcccctgtgtctgcagagcccacacgtgtgtccctgagaacaacggaggcgcggggtgcgtgtgccacctgctcatggatgacgtggtcagtgcggataactatacactggacctgtgggctgggcagcagctgctgtggaagggctccttcaagcccagcgagcatggtgagcagggcggagtgcggcaggggtggctgggtgtgttcccacagctgcctgggctgagggtggggtgggcaggggaggaggtggggtcatagcaacagcaggaggaagccgcctgtattttcccaaatctgatgggattcctgcccctgcctgggcctcagtcctcccacctttgaaacggagctggtcgcagtagaccaccaagcccccttcagcccagctgtttccacccctgaacttaagtgcccaggaaggcgtattgagatgaggtgtgcttgctggaaggcatgcctgctgctgattgaaaaccgaactgggaacattccttccattctgtgtccactggtcagctgctgcggctttggatggtcttgaccgtggaaggctgaccttcttctggtacccggagtccctgcaggaatcccccttgagcttgctgggctgtggtgacaggagtttaaaacatgcgttgtattccagtgatgcatgatatgacatgcatcacaggaataaaaacctgaggtctcatggatatgattgcttcaaaggagaccaagttttaaaacagatgaatcaaaataaagaaaaatactcagtaaatcatcataaagtacagagatgtggccaaaggtgtgaaggatgcagctgtaaaagctgaagtttgaggccgggtgtggtggttcatgcctataatcccagcactttgggaggccgagcccagcggatcaccggaggtcaggagttcgagaccagcctggacaacatggtaaaaccccgtctctactaaaaatacaaaaaattagtctggcatggtggcaggcgcctgtaatcccagctacttgggaggctgaggtaggagaatggcttgaacccaggagaaggaggttgcagtgagcttagatcatgctactgccctccagcctgggcgacagagtgagattacgtctcaaaaaaataaaaataaataaaaataaaaagattttttaaaaggctgaagtttgggttactttggctcatacactttgccttcactgtagaaaggtggttagtaaagaccaggcgcggtggctcatgcctggaatcccagcactttgggagcccagcgcaggcagatcacttgagccctgggctattgaggctgcagtgagctgggattgtgccactgcactccagcctgggcaacagagtgggaccctgtctcaaaaaagaagaaaaaaagggtaattaataaacactaaagttctatgtagaattttagcaacattattgttattataatcttctttgctatggctctgaatctgtgtggtgctccagaagtatgctatggaggttttgtcgaccaaaaatctgggtggtggctgtggtttgtaggccggggctgggctgggtgatgggggagtcactgcatagatcctcacatagaggccgcttctcccgcagtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatgtgagtgggcatgctttgacgtttttctgtgacctctggggaacagggtgggtgaccagcagaggcccagtccctggagccaggagcctgggaggcaagccctggggctggatagcaaatcccaggagctagagacctggcttctcacctggctctgccctaggcaagtccctttgcttcctggccccccacccctcacatcagagaaggggagttatctctgcatgccgctcctcctctgtaaaggtagggctgtgggccacatctgtgtttcccagtttgggggacacaagtgatcgtaggtggcacattgacagctcacttgaataaccctattattgaagagaataatactgactcaagagacagtgacccgtgtcagttcccttttgaggccaacgggttaaggaggaagtccccatacagctgactcgtttactaattcctcttaatgaagagagcagaggccacaccccaggcttagactttcccaagaaaacaagatcagtttgttggttgttccccatggaagctggtcctgacattcccttcacagtagtgttggtggagtttttgttgttgtttgttttgagacagagtctcactctgtcacccagggtggaacacagtggcgtgatcttggctcactgcaacctccgcctcctgggttctagcgattctcctgcctcagcctcctgagcagccgggactacaggcacctgccaccgtgcccagctaatttttgtatatttagtagagatggggtttcactgcgttggccaggctggtctcaaactcctgacctcagatgatccactcgcctcggcctcccaaagtgctgggattacaggtgtgagccaccgcacctggccagtggagttccttcttaagtacatgtattgacatctttaaaaagggcgagaggatttacaggaaactatcaggtcagtaatggcaggggccgtccacagtgggtggctgagtccccctatttttctgctggtgtgcggggaggtcatttcctgccacccatgtttccccaccctgaatccaccttcctcacattcccattggagggacactctctggacatatgggacctggggtcccacagggctgcattccaatgcctgctgtgccactcgccagctgtgtgatgttgggcatatcccataacctctttgtgcctcagtttcctcatctgtaacacaggagtgacaagagcacccgcccacagggctatgacagtacaaggtgtgtgatacagatgagctcccctgtttggcccacatgtgtcctaaaagccatgtgccctttctcttgagtgccccaggccacagagatccccatctgcccgctgtcccacacactggtctgtcatttgttccttgaggtttgtgagggccggctctgtgcatcccaggggcccaggctgggcctggttggctctcagggagcaggcacccgccaccttaagctcccatgctggtgtctgtcactgcttcctctcaatctggccaagccaggggtgtcgatttatatctctcaggtctggtttcccctttggcactgggccaggtatggggaaagagcaggaatggggcagttggctcacacagcagaggctcagaaagcggggggcatggggggaaggagtgcacagatgctagagagtggggcaagttttgtttggtcaataaatctccttctcatgccccaggcctgtgcaagacctacagagagtcccaaggatgggctggggggaagagaaaggtaccaccttcagagtccaaagatatgttatttaatattttcatatttctagatctgccttcaggcatggctggatccagcttctaggaacctgtccagctctgcgccctgctttattctgtactggcttcgtttttaggcaggctcttccctcatgtagtggcagatatgcctactagttgctccaggcctacatcccaaagccacagtgggaaaagggttttttttcttgacggttctaataagagtcctaaggctgctgctcagtggcctggcttcgatgctgtgccagcctctgaaccaatcactggctgtgggtggagagagggtgctggtggagggccctgcttgtccagggaggagtcacatacctgcctctagggctgcaggtgggctcagctccatccaaaccagatgaactgaaaataaggcaggagtggcttccccaggggaaactggggaagaggaagcaggactgtgctggctaaaatgccagccaggtttaagacgtggcaccagatgccagtcatgggattggattggtcagcatgcctgggctatggcttaggggtatgttggtgctcagggatgccacaggcctccagataccaggtctgaggcagaagaatgaagtccagcttctcttgtgggtggaacagtggcaactgagataccccatctctcccttcccaagaacagagctgaacataaagaatttagtgattggccagagcttggccacatgctcccctctgatgaatgataggccaggtgatgggattggcacaattggcttagactaatgagggttggccctggagttgcaggcagtggagttctgtcctaagcagtgggcacctaaacccgatggcataaaagctgggcgggtgtccacctgcatctgccacagcactataggcaccaactgtggctcatactgagtgggataaattccagaaagaaacattaggaacttactatagaattttggggctagagctactcattcattcccctagataatttctaggcaaggttccatagtggagggggagttttggcttgggcattgaaggatgcataggagttttctagatggggaaagaagggaacggtagaccaggcagagggaactgcatgataaaaggtttatgggtgtgaaaattcatggaatgtttgaggattatggggttgggggatgtgggaatatgtgtagcgataaagcaccaaacaaagccaaaagtttagttagagccctgaatgcctgcctcataatggtttccatattttatatgcctactatgtgccaggcacattgctcagggtcacacagctggaaatggcagggctgagtttttgttgttgttgttgttgttgagacagagtctcactctatcacccaggctggaatgcaggggcgtgatcatggctcactgcatccttgacttcctgggctcaggtgattctcccacctctgcctcccaggtagctgggactacaggcacaggccaccacgccaggctaattttttgtatttttagtagcgacagggtctcgccatgttgtccgggctggtctggatctcctggcttcaagtgatccccctggctcagcctcccaaggtgctgggattacaggcttgagccaccgcatccagcccagatctgagatttgcacccagtatttgaactcccaagcctgtgctctttttcctcccatggacatttctctcagagatggtctcccaaacacctgtccttcttgttaaaaaacagacaaaccgcaagtagttctttggaagctcagatttctcttttgtttcttagtaaaacatttcccagttcccagctcccttccagggtgtaagatttcttcggtaacttacatctagctgttgcttcttgtttgctcatgtttagaaagaaagacaaaagagagtgagaattttctctcccttccccagtctccccacaactcacaccccaccctcagctccctctgtaataggaaaatctctgaactctctgtagttgctccagcaatcttttggaactttgcttctttcttgtgaaaaaacctccccttggctcactttgcaccaggtttccccaaatgtgcttccaaccacaagcagaaatggagctgccagtaaccaggaagaaactgccgggggctgaggaagaggagagggaggtgcatagccctggatctcgcagggagaggggtgacaggatgagaactcaggttgctcacttgccatcagggtcagtcatgaatatagcgttcatgtatcactttttaaagcttttttggagggtaaaagtaatagttacacaaaataaaaatacaaatggtacaaaaggacttagaatggaaacatgtttctctcccgactccagcctcctgtttttcttcccagagactgaccactgctgtctgtctcttgccagaagggaaagggaggcaaggttagggcaggcagagggcatgtgcatcctttagagagagcttatgtctatacaagcaaatgtgtgtgttcagtcatcgctgtcttagttttctattgctgcataataatggtactaccagcttcacagctttaaacaacacccatttattatctcatagtttctgtggttgggagtctggacatagcttagccaggttctctgctttagagtctcgtgaggctataatcaaggtgtgggatggggctgcagtttcatctgaggctcaattggggaagggtcacttctaagctcatacaatattggtgacattcagtccctggcaggctgttgaactgagagcctcagtttcgtgctggctgttggttgtagttaaccctgaattccttcccatgtgccctttgcaaagccatcaaggcagagagacttgcctagcaagtaggatattacagtcttctgtaatataatcacatccatgaaatcctctatatatcccatcacctttaccatattctgtgggttagaaacaagtagcaggtcctgcccacactcgagaagaccagatgacacaaagatgtgattcaaagtggggatcatcggggccatcttaggtttgtctgcagtgatcactgtgccatctctctctctctcttttttttttttttttttcgagacgaagtcgtcactctgtcacccaggctggagtgcagtggcatgatctcagcttaccacaatctctgcctcccaggttcaaatgattcttctgcctcagcctcctgagtagctgggattacaggtgcccgccaccacacccagctaatttttgtatttttagtagagacagagtttcaccatgttggccaggctggtcttgaactcctcacctcaagtgatccacccacttcggcctcccaaagtgctgggattacaggcatgagccaccatgcccagccccatctctctttaaaaaacaaacaaacaaacaaaaaacataaaaagaagcagagaacacatacacatctgcatcttcccttgtttacttaacaatagatcttggaagtcacttctcagtagaggctaggttgggcagagcattggattctaggccagtgagtttggacttgaccatggagacactaggaagcccatgaaggacagagagagatgcctcgaccctgccagtcctttagaaagatcacccagtgctttttgtataccaaaccctatttgaaatacttacgtatattaacccatttccttatcaccacaaccctgcgggaagggagataggcacttttattatcttcattttgcagatgaggacattgaggtccagagaggttatgtcacttacttaaggtcacacagccaggaagtggtagtagggactcttacccttgttttacagatgagattgaattatctcacgaaaactcagaaaggttaaacaacttgcctaagtaacatacagctaattagtcgaggagcctgacgcatgttgctctagcctggtcacagttacagaggtggcaagcaatggcctgaacaggacgaacaaccaaatacccaggctggtggctcttaaacatggtggggtcagctaacgacagcaaccagggtgggcactggtgcccctcgcccccggctggtgccctaacatctcccttttctctaccagttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactgtgagtatcaagaggcctaagcaatggtaatctccactctccattcttcccctgtggccagacacttcccctggctgagtctctgggcttttatatcataggatgcctctaatggcaatcctgccattagatacacctgccgtggtgtatctgccaggtaggcaggctaggctgcagtaacacacaagcccacaatttccatggcttaacactataggaatatatttcttgctcatgtaacaagctaacgtgaatgttgctggtttgtaggtggtttccctccctgtagaaatctggggagtgaggttctttccatcttgtggtgccatcattctccaggacaaagattcttacctacttttgtgtcctggtttcctttggcagcctggtgaagcctatggacctcatttcagaatatttttaaatacataaaatcccagcctgggcaatatagtgaaacccccatctgtacaaaaattagccaggcatggtggcatgcacctgtagtcccaggtactgggaaggctgaggtgggaggatcacttgagcccaggagtttgaggctgcagtgagccgtgatcgtaccactttactcccacctgggtgacagagcaagagcccatctctaaaaataaataaatacaatgaaataaaataaaataaatagaactacagaggaaactaattgtattgaaatgcagttataaaacatttaaacacatttttaatctagagatatatgtgcttctttattaagatctataaataataagttctaggggtagctcacataaatactgtaatttcaaagtagataagcataaataatactttatgatactgaaattgtgatgtgatatgagaatagctgtgagttttgttttgctggggacaggatcactgatgctgtcattactggggtctcttccctccattctttttttaaaattgtattttattttatttttaaaattttaaaataaatagagacagggtatcactatgttgcccaggctgcttttgacctcctgggctccagtgatcttcccatcttggcttcccaaagtgctgggattacaagtgggagccagtgttcctggccccttcctccattcttaatggaaggagatgctaggtgtgagaggttagggaaagtaaagatgtaatttctttcccatccaagttctcagacccctgaattctacctgcagccatgttggtccatcaaccccaagtgaagaatccctgctctagggccccaccattgtctgtatccagccagcagaagaggcgtgattatggagatcacatctgcttcttgaaagcagacagcccggaagtgggccgcatcacttcctctcaaattctattggtgaaaatggtcacatgactacacatagccacaaaggaggctgggaactttctcacttggaacctacatcccagaaacaactcttttcagtgaggtatcccacaggtctttcgcagtagaaatattgattatctcacataaaatgaagtcttacaaatggacctactgggttttgtacagcagccaagtgatatctcttcccttctgctgtcttcccttctgccatccttcacatggtggcattgtatccttagacttgccacccatgccctcaggttggccgttgcacactgtcttacataaagcaggaaggaaaggaaaggctgctacgagagagtgtaccttgtgcatctcttttttaatcaggaagcaaacatctttctagaagcttccctagcaaaattccccttacatctcattggccaagactgttacatgttacatggttactgttattacttgctcattgcaaggaagactgggaactcaaatgcctggaaaaaggaacaggataatcgtgattggctcaagccttagggtgggcatggctccctgacaagggagagaggaaaaagctgttgagtgaagaagactgcttcagtttccccatctgtataatgggaggagtaagggctgtcgtgaaaactcaatgaaagaagattcttcaacgtggtaggtgcagtggcagctggcagtaccctgaccctgccaccgcacagccctctcagcattgctcatcctgcactgtggatatcagttgagccacgtgtctcctgccctgggctgtgagctccataggcagggtctccatggctgtatctccagaacccagcacagaaccaggtgcttgggaaagttttgaattgattctcatctgccattggcatggggaagggaactagcttgtatgaaacagataacaatgtatgggaccctcattcattatttcagcaaatatttgctgagttcctcctacatggctagccctgtgctagacactggggaatcggcgatgaacaaagcagatagaaatccccactcttgtggagctgacattctggagggagagacaaaaagcaaacatataaagaaagaaagaaatcacatggatctggatgacagtgagtgctgggaagaaaataaaagcagaggaaggggatggagcgatgggcagggggcaacggtagggagggtgtcggggaaaactttttggagaatgtgacgatgaaagtgaacaaggagaagtcaaccgtgttgagatgatggcagctaatgatgtggacaggccactctgttctgagtgcattatctattgattcatcatgtcatcctcgcaacagccctgcacgatcaattctgtcattaaccccatagtacagatgaggatgcggaggcacagagaagataagggacttgtcctgtgtcacacagcaaggagccatccggctcctaagttggtgcatttgacttctgtgcttccggaaagaaagagcagcaagtttaagatctggaggtggcactgagctttggaggagcagggggcaatgaggtggccggtgtgacgaggactcaatgtgcaagagggagagtggtggggagatgaggtggaggggtggtcggcggtcagatcgtggagggtctcggacgagggtcctgaccctgggtctccagtcctgggaagtggagcccaggctgtaccatggctgacctcagctcatggcttcccctcccacttccagcctacagggagcccttcgagcagcacctcctgctgggcgtcagcgtttcctgcattgtcatcctggccgtctgcctgttgtgctatgtcagcatcaccaagtgagtcctgggcccagtgctgccgagcagtccctctggagtgcagggtggcagggacttgcccctctagtctgcccctttgcagtcctctcagtcaataatacgtatttactgagcagctactacacaccttgagagtagagctgagaacatatcgacaaggaccccacttttttctttttttcttttttttttttttttgagacggagtctcactctgtcacccaggctggagtatagtggcacaatcttgcctaacagtaacctccgcctcccgggttcaagcaattcttctgcctcagcctccagagtagctgggattacaggcgcatgccactatgcccggctaattttttgtatttttggtagagatggggtttcaccatgttggtcaggctggtctcgaactcctgacctcatgatctgcctgcctcagcctcccaaagtgctgggattacaggtgtgagccactgcacccaaccaggactccacatttctaaaaccggcatcctactggggagactgaaaatacatatcaatcacaaacaggtggttttccatagtgacccactctctgaatgcactagaccagggtggaggccagagatcttctggggtgctttttgcaagggggaccaggataaggctctccaaggagggaaaatttgaggggggccctgactggggagaatgagctggccagggataagcaagatggagtcatcccacatccccttacaacactgggtgcctgggcaactgggggcatttgggggcatgtggtaggagccagaggaatttgcgacgattgccctgatggagtcaggagacctgggtttgaatcctggccttggagcttggtagctggcggccgacaagttgctgaaacccctgagcctggggttcctgctttgcagagtgacagtgatggtgagaacatatttcatcagccagaagaggccaaatcacagtaaaggctgagggaggagatgagtggcgagtggctgggaggtggtggaaggagcctcgtttccagagagctcttgccagcccttggaatcatggtgtctcagagcctcagtcctcccatctctgaaatgggactagcaagctcaacctcactaagtcaggattagaggtggctaaggattattaacatgattgatgaaagtgcccactcttggcccagcacacactaggtaggcagggaatgcaaattcccctccatatcttgtcactgatgcctccgagcaaccttggactgatcgccttgctctgagcctcagtttccccatcacctgtacctcttcccactccccatcactatatcccagcatgccagcctctttgctgttctttgtctttggtttcttgttttgttctgttttttagacagggtctcactctgttagccaggctgaagtgcagtggcgcggttacggctcactgcagcctccaattcctgggctaaagagatcctcccatttcaacttccagagcagctgggacaacaggcgcttgccaccacacctggctaattttcttattttaatttaattttattttattttttgggacagagtggagtctcaaaaaccaagctagagtgcagtggtgcgatctcgactcactgcaatctctgcctcccgggttcaagcgattctcctgccttagcctcccgactagctgggattacaggcgtgtgccacgacacccagctaatttttgtatttttagtagagatggggtttcaccatgttggccaggatggtcttgaactcctgacctcaagtgatccacccacctcgttctcccaaggtgctgggtacaggcatgagccactgtgcctggccaattttcttacattttgtagagactggctgtcacttatgtagcccaggctgatcttgaacttctacccctttatctttattcatggcacttattaccatgaatgaatgacctcatataagcatttctttcgtttttttttttttttctttgagatggagtctcatgttgtcccccaggctggagtgcagtggcgcgatctcagctcactgcaacctccgccttccgggttcaagcgattctcctgcctcagcctcctgagtagctgggattgcaggcgcctgccaccatgcctggctaagttttgcatttttagtagagacggtgtttcaccatattggccaggctggtctcgaacttctgacctcaggtgatacacctgccttggcctcccaaagtgctgggattacaggcgtgagccgccatgcctggcctcatataagcatttctgtctccatttatcatccatctttccctcttgaaggtcagtttcaccaaggcaggcatctttgtctcgttcactgttgtagcctcagggccaggcacagtgagtcaaacatagaaggtgctcaataaatatgtgtttatttattgaaaccatgggcagaggctaattcagaagcggtctgaggaccttacctcccagtgatgatgcaccatggccccaggcaggccaggaagagagaagggttgtgtttctccgtaggtcccccagcttcccaggccatcccaggccattccctggtcatttgccctcagctgctctgaaaaagggattgttgaggggaacctagaatcctctctctgcagtttgagtctttcctaatcccctggggtctcattcccactgaggacataggtggcctcctcaggaactctgtgctgggtaacagaatgcgggagtgtgaacctggctctgccacctaccagctgtcactccacctccttgggcctcactctcctcatctgtagaatagggttagcaatagaatccatgtcaccaggttagaatgatgagtcagtggtttgacctccagaaactaatcagcctgatctctgatgccaaataagtattggtgataacgaccacttttatgggaggagcgttcacctgtcaataattcagagatcaacaccttttccttttgtttttcaggattaagaaagaatggtgggatcagattcccaacccagcccgcagccgcctcgtggctataataatccaggatgctcaggtaggagtaggcgtggatgaggacatgtgggactgtgtacatgaagaagtgtggttcagaacacctgggctgttaaggaccttcactggcttctggaatggcaaatagacagtcaggagggttgcaggggagacagaggcagaagccgaatgaggtcattagcagaccagaggctttcccgcccttccccttggcaatcccagcctggggtgggcttctctggggttggtttcctgtttttttccctccccttgggagaatgacccttgggtcatcatcactgtgtcattccctggggaggtgccagtaccagggctagaggccagaaggagtggaggaaggagagggtgacaggctttctgtgtcttcttcttaagcataggaaactgcccccgaagcactagcaaatcccttccgggttctcattggcctgaaatgtatcccacccctaagccaggggtggagtcagcttccccaaggcgatggtcctgtgggtgagtgggtggggtttgcctgagcaagatgagagttctctaggtaggagaaagggggattataggtcctgtctagaagagaaggtctgagggtccttgcttttccagggactctggaatctagtggtgttggctttgaatcctgactctgccactcactggcagtgtggacttgagcaagttgcttaattctctgagcctcagtttcctcttgtgggttataacagtgtttacctggtaggacagatattggaatttattgagacaatacatataaagtgcatattccagcctcttgcaaataccaagtgccatttatgtatcagttagtgtttgctgtgtaacaaatgaccccgaaatgtagagggttacaacaactttatttagcttatgcttctgcaggctggcatttggggctgggctcagcagtgagggtggcgggggaggctgggctgggctgggctgggcagatctgaattgagctgacccgtccccgtagcctccctccgtgtctgacagttggctttttttttttttttctttttctgagacggagttttgctcttattgcccaggagtgcaatggcgtgatcttggctcactgcaacctctgcctcctgggttcaagcaattttcttgcctcagcctcccaagtagctgggattacaggcatgtgccaccacgccaggctaattttgtatttttaatagagatggggtttcttcatgttggtcaggctggtctggaactcctaatatcagatgatccacccacctcagcctcccaaagtgctgggattacaggcgtgagccactgcacccagcctagttggctgacttttacctgggacagtgcaggtgcctgagccatgtgcctctcactctccagcaggccggcccaggcttgtttacagagtggctcagttttcaagggtgggaagtcccaaggcttcttgaggcctaggcgcagcactggcatgatatcacttccatcacattctatgggcccaagcaagtcccagggccagtgtagattcaagggatgggaggagattcagagcactcctctgtggccacttttgccatcgaccacagtccctgtaaatattaggacaatgtaattaattcccaggaatctgaggctcagaaagcgtaagtgacctgttggacttctgatctgtgtgatgtcgaggcttgtaccccttcctgagcattgccgtactccaggccgggctgcaaggccactctgctctttcattggctgtctctgtattttaggggtcacagtgggagaagcggtcccgaggccaggaaccagccaagtgcccgtatgtatctgaacttaggtcacagcctgcatgcattgggaaggtgatagaattggagaggcaagcccctagctccatgtctgccttctcttccctgcattcggtaattgccctgtgacattagccttcaagggacggcaggaggaggggtgttctggaaacgtggactgctggccaagccccctgagtttcactggtgtgtcaggtacatggtgataccccttgggagtgctgttatagttaacaaccagagcagccgtgcctgttgttaaaatcttgacctaattgtatacttgtcggcaaatagccactatcctgaacactcccctccttttttttaatatacaggatctcactctgtggcccaggctggtgtgcagtggtgcgatcatagctcactgcaccttcaaactcctgagctcaagtgatcctcccatcttagcctcccgagtagctgatactacagatgtgcattaccacgcctggctattttaaaaggtttttgcctgtaattccagctactcaggaggctgaggcatgagaatcacttgaacccgggaggcagaggttgcagtgagcgcagattgtgccactgcactccagcctgggcgacagagtgagactcttgtctcaaaaaaaataataccaaaaaaagtttttgtaaagacaagctctcgctgtgttgccccgccactgtggcctccttagcttcttccctggggcctgctggacctttccatactccagaaactaaagggggtccaggaccctgcttcaaccctaggatcccgcatcttttttttttttttttttttttggacgcagggtcttgctgtgtccctcaggctggagtgcagtgattcactgcagcctcaaactcgtgggctcaagtgattctctagcctcagccttctaagtagctgggactacagtcatacaccaacatgcccagctaattttccttttttttaattcttgtagagatgtttgagacggcttgggctctgttgcccaggctgttctcaaactcctgagctcaagcgatcctccctcctcagcctcctaaagtgctgggattacaggcgtgagccaccgcacccggcttccatatcctttctaattggtcatggcttgggataatggtgttgcttttaattatcatcatccataaagactttttcttactcaacagatctgagcttgtatttggtgcccaggacatgtgctgggttcccgaaatcccaaagacacagaccctaccctcagggatttctcattctagcaacatagactgatcaattactgattataacgttagaaggcatgtctgaagtagacagccatcaggacatggtgatttcaggctgggctttgaagaatgaataggagtttttcaagtgtcgaaactgaaccctgaccaacctttgcttttgcagacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacatggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctgtgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctctttattttttatgtattaaccaaacatacctccagacactgctgtgagtgctgtgtctctgttaactcctggaattcacccatccagaggaaccaggatgcaagaggttaagaaacttgccgtctgggtttgggttccccatacaaggattcaaatagttgatttaggaagtaatcccgggaaaccctgctaaggtagtggggaactgaggcagggaaggacacaaaccaagaaagtgttacctgaaaggggtccagatgcagaccccaaaagagggttcttgaatctcatgcaagaaagaattcagagcgagtccatagagtcagtgaaagcaagttaatgaggaaagtaaaggaataaaagaatggctactccgtagacagagcagccctgagggttgctggctgcctatttttatggttattgattaattatattccaaacaaggggtggattattatgcctcccttttagaccatatagggtaacttcctgatgttgccatggcatttgtaaactgtcatggcgctgttgggagtgtagcagtgaggacaaccagaggtcactcttgttgccatcttggttttggtgggttagagccatcttctttactgcaacctgttttatcagcaaggtctttatgacttgtatcggtgacgacctcctgtctcattctatgactaagaatgccctaacctcccaggaatgcagcccagtaagtctcagcctcattttacccagcccctcttcaaagctccagtttaaataaacctctgacaaaagggtgagttattcaacagattaccagcatgagtaactgatgcttacctgccggggatctctggaagaccatgcatggcacatgcccagttatgcctgcaaaggagagggagctggggtatttgtccaccagctcccatctgtcattggctgagagctgcttccaggagcattaattctccagcacttccagctactccaggaaaaaaaaaattcttcaactgagagttggaggtgttgagagactctggcacaccaagaagacaggaacaggacaccaacagtggctgatgatacactgccaaggtcacacagctagttagcaacagatctatagtggaatccagacagtgtctccatcacccaggctctctgtagtgatctgcgcttcacatccgaggcaggcagagggatggtgtgggccttagatgggaaggctgggaacctgaagctcctatgtctgtatcacttttgcttctctgagtagctgccctgatttcacacttgaggggcttggccattttagattccttcctgctctaggagcctacatactacactggaaatgatggggagctctctacctcacatgcagcctgatgtttgttagaaacacctccttgcgccaggcatgatggctcatggctgtaatcccagcaatttgggaggctgaggcgggtgtatcacttgaggtgaggagttcaagaccagcctggccaatatggtgaaaccctatctctaccaaaaaataaaaaattagccgggtgtggtggtgggtgcctgtaatctcagctacttgggaggctgagttggtagaattgcttcaacctgggacgcggaggttgcagtgagctgagattgtgccattgcactccagcttggatgacagagtgagaccctgtctcaggaaaaaaaaaaaaaaacaaaaaaaaccttgttctaagccaaaatcaatccctttagctgcccaaatcacacagtttacagatggagaaacagttttagagaggaaaagggacttgcccaaagtcacccagagaatggcagagcctgaactagccttctggacttcttgcctccaaaagctctttataataaaatataattttaaataaaaatagttatctgtttagggccaagcaatatgctaagtgccgtccagccactgtgtcatttacgtctccaaacagctctagttgggaggctcaatgattatccca

SEQ ID NO: 28 - DNA, 10544 bp, Human
taaactttcctattttgttattctaaactgctataagaaacatattttatatgtatctatgagtattatacagagatatatacaacaatgtaaatttttttaatatggcaatcaacaaaatgcttacaagcaagaggagagaggcaatgagatgccttatccatttacatttccataaagggctatacaaggctttgtttaaaatacagaaaattgcttgaaggggagagaaagggaaaagaaaaaggacaaatctttagttcattcactggtcaaactttcaattatttcaattattgattagtcctgaatccatactactttaattctgtggaggtagaaaaatgatgtgtctatgcctgtgtatggaattgtcctcctcaaccagttcacctgcatagtcaatttgattttgattcaaaacgatgaaattaaataagatgaaaaatttggactctcaacttcccacctttattagattttttaggatcctaaaaactgattttaaaggcttcctaatattgttaaacagagtctaactaccaaaattgacaacaatagtgtttacttccacctttgagggaaagtgtttctaattgggatgattcctaactgcaagttaagccaataatattttttttaagctgaaagcaaagtttgaaaatttttttctcctgaaataaacacagcaatcttatgtaaattaacataatatgagattatcaaattaaggggtttttgcaaactctactgcaactctaaagtaaacccaaatttaagcaagaaaatctgaagtcatttactgaatatagcgtagtgttgtgaataagggatctaaatcctaaaagcctaaaagtaattaagaattggggtcagctattttcacaaaaatttatgaatattaatagacacattgataactttatgtaataactcaataatttagatgatggtctaaatccagtacccccttcaaggaattttatccgcttttatgtactaccacatattatataatatcaaccaattaacataagaatgtgcttttcaaaaataaaaagggggtatcatcattccaccgcgaaccagcctgaacactagagtattaattaataaaatagaatcacagacaaagacggtccttggttaaaactattaatatatatttaagacaatgggtttatttttaaataagaaaacaaggaaaaggagagcccagcccgatcttgtgtgcctacccaatagaactttccaccataattagtgcttaccaactttgaggggaggagcttaagctcagggtaacctcatgtagtaagggaaaaacagtataaataccactgaacagctcttgagaggcaccttctgcactgctcatctgggcagaggaagcttcagaaagctgccaaggcaccatctccaggaactcccagcacgcaggtaagcgtacgcttactggtggacttccatgttaacttgcttggaaagaaactttaaagatttaaatacttgagttttctcaagtattagaagtattaaagtgatttaaaaaatgggtttctactaaaatgcactccaaaagttctttttgcatcagtctgtggatgatagtcccaataaaaccatattgtaaaaatttgccctaatccgaatttcagtgtattttgaaactattagatatttcaggctatgtcaaagatcctagattatttaatacagacatccaatcctaatttctgtttcttttcctttaggtaaatcattttattttcacttgattacctgagtatagcttccaaaaataactaagacatatattcacataactaaaaaatgatctctcatttatttatggcacatattaaaaatatataggataggttaaaaaagtagataactgtataaagaactcatctgtgaaacatgagaataaaaaaataggttaataacaatgctgtataaagttattcttttctgtttttcagaatccatctgagaatatgctgccacaaataccctttttgctgctagtatccttgaacttggttcatggagtgttttacgctgaacgataccaaatgcccacaggcataaaaggcccactacccaacaccaagacacagttcttcattccctacaccataaagagtaaaggtaaattgaattgtatattttgttctattaacaagttgcttgttgctttctataatcttaataatctctttaacaaaatgcatttaactttggtgttactttccaacttctgaattagcccaaattattacaacaaagtgatctgtgaaaaaagtagaacaagaatatccaataagtgtagtagaaaggatatacttgaaaatatagttgaaagatatacctgcaaaaaatcagaacttttgtgtgtacaaatttttttctcagatgctgcttttgcacaaataactgcatgtaatccagaaatcttgatctaatcaaaactaatcaagtttaaaaattttaagctaaaaataactgccaattgtataaagaaggtagctggtttatttagctaaatattaaacatttacttttaaaactaattcaactagcccacaaacagatataaaaccgagtcttatcaaaaaaatctgatggcctcccccccaacaatgaacaaatgtaattatgagaattgccaagcaggcaaatgaaactgcaattctcataattacttatacattttgaatatagtttagcggtaaaatgcagagacttaactgtaatgcataagctgtgtgacctgaggtaagttacttgtcctcccatgccttagtttcctcatttgtaaaataaggagcagctatctcaagggctgctgcgaagtttaaatgaattaatacctgtaaagtgctttaagtgttgctattacttctactactacttctgttactcctagttttatttctactacttttagctactaatatagccttcaataagttaactttcttcttgaatctgttgcttacctgtccagttttcttggttactctttgaagattactgagataatatatgtaaagcactaaggttctcaaaggagggcaacttctaggcctcatattcactaattttatttaacagcaactgacacgaccgcctataaaatatctacagaataatataaactgactgtaggcttcaaactccctttccataattttttaattatatattttatactgtaaataaagctaaggatatttgttataaagtttaaatattatgcttttgggaacaaccattttgagcaatgaaacttatagaattgtctttttaagaagaaagatggaatttaaaatatttcacaaaaggaaacttaatatttgaaaataaatgcacaggtatacaacagatacttttgaatgtctcaaaatataaataaaaattttaaaatttaaaggctagtaaagaaaaaaataaaagacaaagcaaccttccgctttacttgaagcaacaaacacaatttgaaatgctatgacaaacagcactggattcaatagtttccatgatcacaaaaatcagactttttaacaccttaataagagcataacaaagtcttgaattaaaaagaaaatgcactattttagaaggttaaaaatactttgatcttctcttaatatacaccattatcttggctacttttgcagaacaaatgaaaatatcttaacaaatgaaaagttcagaagctgtatttaaactactaaatccaccttagtctctttttagatagacactcaactacactatcatccattggcagacattaatgcaccataacaaacacaaaagcccacagtctatacaagtaagacattaagttgaaacaggaattcaaagagttattacataattcctaggcatatccatccaacacaggttaaaaaagagttctgtcaaaacatactaaattatgctgcagaggattccacagctggtgggcagatgcacgtgccacattctgacacaaccaatcacgatttcagtttgtggcatttaaaaaacttaatagaaggaagtagtcgttttaccttgaggattgtgccaccctaatcttgaatgaagaaaattttttcagatgacaacctacaaacaggggctgtcccccaagcattcaatagaagccaaattctttctcgcactgagaagttgagacccattaggacaacattccaagtgacaaagttcgccctgtcactggagttccagtctcggatgacgcccaatgcactcatttccattgacttgtttctcctttttaatagtaaaacagatttccaatcagactaagacaattatttttagtgtgaacatgacccttataatcagattctaaagcaaagctcaatctaacatagttggcattttaaaaaatccactattttattcctccaacccattaaaaaattccttatttattcctctatttgcaatatatcaatatccacttatacataatataatcatgtatgtacactacaatcaatgaaatatttaatatacggaaatcttttacataaatttttctcacagtctttttcctgatgtcattttctgaaaatccatggggaaagctctatgtatttatattaatcaatgttttcaaattgaaatataactctaattagtaaaaaaaaatctaaatctgaaacaattattttcctatttcggcatatctattttaatgattcgctctgcatttatatacaccaaatgttttccaaatctcagaaacatctgtaccctgtgctttccccatacttgtggcccagccgcatttttcacatcacaggcactatgatttttagtttaagtttagtttatcaggtcaagtgaactcacagctctatgaaatcaaacactatatatttgtatttaggtaagaactttaatactattttatgtacctcacctattatgtctaattctctagttctttgtttcaattttaagtcaataatggagagtataagagctcagagtatattctgaggtaaaagtaaatcaaccaaaatctaacctgtgttcagcagaggcatggcagatgtaaatcagaattaattctgtttctcttttatgtctgacagggtagctttgggagggaaaatttttatagttcttaaacattttctcacttattctgcactgtctttttctgccttttctgtacatgattttcccaaaataaatgtactaaatttacctccactgcacttattctagaggaattcttcaatcctagctcattttcatgaatcactgtcatgggataaaagtattatggtagccatggttttgtgaaaccatcttctccagcagaattttttaaaacagtataaaacatataatctaaaaccatttcagactgttctgtctacatggaataaatgatgctgaaatatcgtgtcccaattcatagtttgaaaggcaatgattctctttaatgtcactaaccatccccttctatgggtgggtgtgttgggtgtgtcttttaggtatagcagtaagaggagagcaaggtactcctggtccaccaggccctgctggacctcgagggcacccaggtccttctggaccaccaggaaaaccaggctacggaagtcctggactccaaggagagccagggttgccaggaccaccgggaccatcagctgtagggaaaccaggtgtgccaggactcccaggaaaaccaggagagagaggaccatatggaccaaaaggagatgttggaccagctggcctaccaggaccccggggcccaccaggaccacctggaatccctggaccggctggaatttctgtgccaggaaaacctggacaacagggacccacaggagccccaggacccaggggctttcctggagaaaagggtgcaccaggagtccctggtatgaatggacagaaaggggaaatgggatatggtgctcctggtcgtccaggtgagaggggtcttccaggccctcagggtcccacaggaccatctggccctcctggagtgggaaaaagaggtgaaaatggggttccaggacagccaggcatcaaaggtgatagaggttttccgggagaaatgggaccaattggcccaccaggtccccaaggccctcctggggaacgagggccagaaggcattggaaagccaggagctgctggagccccaggccagccagggattccaggaacaaaaggtctccctggggctccaggaatagctgggcccccagggcctcctggctttgggaaaccaggcttgccaggcctgaagggagaaagaggacctgctggccttcctgggggtccaggtgccaaaggggaacaagggccagcaggtcttcctgggaagccaggtctgactggaccccctgggaatatgggaccccaaggaccaaaaggcatcccgggtagccatggtctcccaggccctaaaggtgagacagggccagctgggcctgcaggataccctggggctaagggtgaaaggggttcccctgggtcagatggaaaaccagggtacccaggaaaaccaggtctcgatggtcctaagggtaacccagggttaccaggtccaaaaggtgatcctggagttggaggacctcctggtctcccaggccctgtgggcccagcaggagcaaagggaatgcccggacacaatggagaggctggcccaagaggtgcccctggaataccaggtactagaggccctattgggccaccaggcattccaggattccctgggtctaaaggggatccaggaagtcccggtcctcctggcccagctggcatagcaactaagggcctcaatggacccaccgggccaccagggcctccaggtccaagaggccactctggagagcctggtcttccagggccccctgggcctccaggcccaccaggtcaagcagtcatgcctgagggttttataaaggcaggccaaaggcccagtctttctgggacccctcttgttagtgccaaccagggggtaacaggaatgcctgtgtctgcttttactgttattctctccaaagcttacccagcaataggaactcccataccatttgataaaattttgtataacaggcaacagcattatgacccaaggactggaatctttacttgtcagataccaggaatatactatttttcataccacgtgcatgtgaaagggactcatgtttgggtaggcctgtataagaatggcacccctgtaatgtacacctatgatgaatacaccaaaggctacctggatcaggcttcagggagtgccatcatcgatctcacagaaaatgaccaggtgtggctccagcttcccaatgccgagtcaaatggcctatactcctctgagtatgtccactcctctttctcaggattcctagtggctccaatgtgagtacaccccacagagctaatctaaatcttgtgctagaaaaagcattctctaactctaccccaccctacaaaatgcatatggaggtaggctgaaaagaatgtaatttttattttctgaaatacagatttgagctatcagaccaacaaaccttccccctgaaaagtgagcagcaacgtaaaaacgtatgtgaagcctctcttgaatttctagttagcaatcttaaggctctttaaggttttctccaatattaaaaaatatcaccaaagaagtcctgctatgttaaaaacaaacaacaaaaaacaaacaacaaaaaaaaaattaaaaaaaaaaacagaaatagagctctaagttatgtgaaatttgatttgagaaactcggcatttcctttttaaaaaagcctgtttctaactatgaatatgagaacttctaggaaacatccaggaggtatcatataactttgtagaacttaaatacttgaatattcaaatttaaaagacactgtatcccctaaaatatttctgatggtgcactactctgaggcctgtatggcccctttcatcaatatctattcaaatatacaggtgcatatatacttgttaaagctcttatataaaaaagccccaaaatattgaagttcatctgaaatgcaaggtgctttcatcaatgaaccttttcaaacttttctatgattgcagagaagctttttatatacccagcataacttggaaacaggtatctgacctattcttatttagttaacacaagtgtgattaatttgatttctttaattccttattgaatcttatgtgatatgattttctggatttacagaacattagcacatgtaccttgtgcctcccattcaagtgaagttataatttacactgagggtttcaaaattcgactagaagtggagatatattatttatttatgcactgtactgtatttttatattgctgtttaaaacttttaagctgtgcctcacttattaaagcacaaaatgttttacctactccttatttacgacgcaataaaataacatcaatagatttttaggctgaattaatttgaaagcagcaatttgctgttctcaaccattctttcaaggcttttcattgttcaaagttaataaaaaagtaggacaataaagtgatgggtggcttttacagttgtcatggatatgtccctatattggtgatgcatctttattcccacagacccaaccactcattgttgactgtgaagaggtacccacaaaaccacatgcaatctgagtcagggtcaagggctgatgactagggatagaaaaatgacaaaatcaccccaaagttgtaattttctcctgggagggaaagaagcaggtgacagagaaatatgcagtttgaacaaatattctgcagttactatttattgtcttgacatgtttttggttataatatttaaaattgttttgatggcttgaattacattttaaaaaggcaagcaatttttttgtcaatcacaaggcaacattttttccaagctgaaaaatactactcttaagaatccatcatcctattagtttaatcaggacaatgtggctcaagtcactgaggtaacatactataaaggcatctatttattccttagaagcaatcttgtgtaatccaagcaaagctgtgattggaaaggtaaaactctgggctcaagattggtgatatctctgccctcactctgggtcagccagttttgttccttaagcaacaagaacaaaatttctgccggcagacattttgcccacctgtctataactactacactaatggttacaagtcaccaacccttatgcccaggccatgaaaaagcaaaactggacttcaattctagggaactcacagaatgaccctcgtggcaggcgtggtaaaggagagtgtaacagcacagcttggaatatgggcaattatagccatgaaagaagcacaaataaaaggacttctgaaaatgtagtcagaaccaactttataataatatttaagctcaaattaaatcctaagtaagatacacagcaaagtacctacttttcagctaattcactagacaaacatagcttaacaaacacgtattagaaggcccctcttcacaatacttacccttaaaagctgacattttataattgtgttgtatagcagcaactatatccttccaaaaatcaaatgttttttgaccattgttcagctgaaaaaataattccaaatgaaacaaacacaataattcagtttttaagcatagtgaaaaatgctggcaaacaattacaatgcagacagtccctgacttaagatggttagacttacaatttttttattttataatggtacaaaagtgatgaagattcagtagaaacttaacttcaagtacccatacaacaattgtttttcactttcagtacagtattcaataaattacatgagctattcaatactttattataaaataggctttcttttgatgactttgcccaacagtaggataatggaagtgttctgagtatgtttaagataagctaggctaagctatgatgttcagtaaactaggtgtattaaatggatttatagtatttttgacttaacgatgggtttatcaggaaaaaaccccatcataagttagggagcatctgtattactatattctgatataagtttatattttacaaaacataataaagttatcattcttctaaatgtaattttaaaaagaaatcttccatgaaaatcactgctacatatacacatacatatcactaaattttaatatagctcatatagcccaaataaaataaaaatttccactcgttataaagtctaaaaattatagaatatttttaaacacagcaaattcatagtgttatataatttctgggatatcagaatgtgttatataacatactatggcatcaatgggactaagaagactgacgccctaaaaccccaaaagctagttactttagaattcagtgcacacttaacctgaatttcgatatgaaagagctgcaagtctcaacagaagagatgaatgaggttccaaatccgaactgtaaattgttttcattaagtttttttaaatcagaaagcaaataaacattacatt

SEQ ID NO: 29 - DNA, 143776 bp, Human
  misc_feature (1)...(143776): n = A,T,C or G
ctcatctcttcttcatacttgataaaattctccccaaaccttgtccaagctttgaatggaacagtaatagtattacggtaaggtggtctcacctcacttaccttcaggaaaattccatatttattagagcccacatcaaagtagaaccttttattgtccactctgaaagaagtcccctctgggagttcaagcgggtcatcgtctccacctcttcgttcttctatgtctccttcgccatagtcttcaatcagctgaaccaaggcatcacgaaactcaatcattccttgtgctgggaggacaatagtctgttcttggcccaaactgtggccaaaataacctatcatgccagtcccccgcatcatggtttgtctaatccgtaggaagcgaccccgctgattttcctttaggtctaggtaatatttcctattgtccctctcgatatagtctgttttcaggacactgtgaggatgctcttcggaccccaccgagactggtggggagggtgccgagtgcttctgcctccttctggagccttgctctttgctgtggccatgctcttgccggtggcctttcaggcccaggtgggcatagtgctcgatgaagtcccctagacagtccttcagctccgctgccacagacagggagagggtcagtttactctttctgatgttgtcctgccggcctctccctatccagacttcggctatctttaggaagcggccccgggagctttgcttcacgtctaggtaaaacctctttttctggatgtccactcgtttggaggccagctcctggatttcggctgcgcccccggcctgattaggggtggctgaggccgcgtagtgggggtagtgggagtgctgggcctggggatagagtctactcttgcttaggccagagccccctacattcttgcctccgcggccgcggccgccgccgcctccccttcgcctggctctttccatcttcagctgcaagtaacaaacagacacacgggatggggtgggggaggggtgttgagaacaatcgcagacgcccctcggcctgaccgccccgccgccgcccgcgacccccacgccgggcccggctcccccggcgccgcagcgcggggctccagccactgccggccggttggcggccgccgctccggctctgcccgcgctccccgcatccctccgccgcccccggggccgctcccgcacgccgccgccgcccgtcccgcgctccgcggccccaggtctccagccggcgggcactcacatcatctctgccatcaccgccgccgccgatgcccttcacgaccaccgccgccgccaccgccagctctcggcccctctgctgcagccgccgcagccgccgccccccgcctcctcccccgccgccgccgctcgcactgccccccgccggagcagccgggcaggggcatcgcccgcggcgcccaccgcagccgcccctcctgcggccgctgcgggggccgccgcctgacttcggacaccggccccgcacccgccaggaggggagggaaggggaggcggggagagcgacggcggggggcgggcggtggaccccgcctcccccggcacagcctgctgaggggaagagggggtctccgctcttcctcagtgcactctctgactgaagcccggcgcgtggggtgcagcgggagtgcgaggggactggacaggtgggaagatgggaatgaggaccgggcggcgggaatgttctcacttctccggattccaccgggatgcaggactctagctgcccagccgcacctgcgaagagactacacttcccgaggtgctcagcggcagcgagggcctccacgcatgcgcaccgcggcgcgctgggcggggctggatgggctgtggtgggagggttgcagcgccgcgagaaaggcgagccgggccgggggcggggaaaggggtggggcaggaacgggggcggggacggcgctggaggggcgggtcgggtaggtctcccggagctgatgtgtactgtgtgcgccggggaggcgccggcttgtactcggcagcgcgggaataaagtttgctgatttggtgtctagcctggatgcctgggttgcaggccctgcttgtggtggcgctccacagtcatccggctgaagaagacctgttggactggatcttctcggggtaaagtgtcttcctattcccgttttcccagctccgtgccccggggtatctatagtgctaggcttctgagacacgtggaggcgcttaggcccgcggagcaggcccctgggctgtgtttgggagattctggaaaaacagactttctcccttttcctttcccctctggagcagctgggaaaggcgtctctcggagcttccgccattcagaaagtgtttccccgcccctgacggccccagcttgatgtttaccttgcgcgcttagttaggattgctctttctagtacggcctttattatggcagaaattgagccactacaggtctgcacagcaaagtcgagggaaataacctgctgtctatgatttagcaagtgatgatggatatttttgagttcaaatcactcagtctttaatggattttcttttctttttttcctagttgaatctcagttgttctcaggctaggtttgatatgaaaaatactactccctattgaagagggtaatataattcttaggatgctaatacaggagtctgtaagtcggagtacttcaggctttttatggttcggtacatttctttttaggggtgggatattgggataagtaggacagttcagatcttgatgtcattgaatagtggtgtctacctaaaaggaagaggctggggcacaaaattataatttaaagtgtttacttcagccaaaatgaggacagctgcccaggactcatttcccagttgccttggggagtgctccttcagccttggttacaagcaggtttttaaaggcgaaggggaagagtgggctgagacaaagttggtcaggaattgttattggtttacagagataccattgcttagtgattggctgtacactgtaactcatagggtatgagttatcgtgtccagcatatggcattttatggcttcttggttccagtctagagcccatatagcaggtgggctttaagagataattatccagctcagaccgggagtgagacgggactgttttttcattctaatgcctctctgggcctgataatttaaaggggcttgcattcttcagctaaaattttattttcttttattttttttcccccacagtggtctccctttattaatccaacaaatgtttattaaggactgctctaggcactagagataccaacaatgaacaaaacagacaaacatctctctccttttggagcttacattttagtggaaagagacaggcaaaaagtaaaattataggatgacagaaggtgaaaatagagattaaaaaggaaagggggatgaagagtgtgtgtgtgtgttgtgggtggggggctgtagggagctgcagttttacaataagtggtcagggacgtcctcgctgagaagggaatttttgagtccagagctcaaggaagtgagagaacttaccttgacgttctctggaggagaagaaagtacaaaggccctgggggaacctgcctctttatgttcagagagcaacttaagaggcctagtgagctggagcagagcggagaggaggtcagaggtcaggccagaaagggaaaggggccagaatgtgtaggactttatgggctatattgaaaattggggctttcattctgagggagatgggaagctgttggagagttgttagggaaacgtgatctgaattatgtttctaaaaaattggagtaagatatcataaaatttgccatcttagtcttttttgtatctggccaattccactcagaattcttttttaaacagctttattgagatataattaatatatcatatgattcactcatttaaagtgtgcaatacaatggtttttagtttgtcttcagagttgtacaacctttatcacaattacctttaggactttttcattacccaaaagagaatctccataaccattagtactcaatcccacccgctttcctagcaatcacttacctatttttttgtctctatatagctctcaaaccctatgatattccttctatctaactgtatttttgtactcattaacagcctctcttcattcccaccacccatccatcccagcctctggtaatcaccattctacttactacctcaatgacatcaaattttttagctcccacatataagtgagaacatgcgatatttgtctttccctgcctggtttatttcacttaacagaatgtcttccagttccattcatgttgctgcaaatgacaggatttcattctttattatggcttaatactattccattgtatatgtatatcacattttctttatccactcatctgttgatggacagttagcttgattccatattctggctattgttgaatagtgctgcaggaaacatggaagtgcagatagctctttgacatactgatttcatttcccttgaatatataccctgtagtggatttgctggacccgcttgtagttctacatttaatattttgagttatttccataatgttagtaataatttacattcccaccaacagcgaggaaggagttcccttttctccacatcctcgccaacacttatcttttgtctttttggtaatagccattctaacaggtgtgaggtgatatctcattgtgattttgatttacatttccctgatggttattgatgagcaatgtttcatatacttgttggttatttgtatatctccttttgagaaatgtctattcaggtcttttgctcattttttaaatatggttttttaatttttttatttttttgctattgagttgtttgacatccttaaacattttggaaattaacctcttattagatgtatagtttgcaaatattttatccgattctgtagattctgtcttcagtctgttgaatttgctgtgcagagaagcattttattttgatgtaatccctttgtctatttttgcttttgttacctttgcttttgaagtcatatccaaaaaatcattgcccagatcagcagtccccaacctttttggtaccaaggactggtttcatcgaagacaatttttccatccacaggagggaggggatggtttcaggatatttcaagcgcattacatttattgtgcactttgtttctattattattacattgtaatatatagtgaaataattatacaattcaccataatgtagaatcactgggagccctgagcttgttttcctgaaacttgagggtcctatctgggagtgatgggagacagtgacagttcataaggcattaggttcttctaaggagcatacaacctagatcccttgcatgcgcaattcacagtaggttttgcgctgctatgagaatctaatgccaccgttgatgtgtcaggaggtggagctcaggtggtaacgtgaggaatggggagcagctgtaaagaaaaatgaagcttcgcttgcttgcctgctgctcacctactgctttgtggcctggttcctaacaggccatggactggtactaatctgtggccctggggttgggaacctctagccctgaccaatgttagggagcttttttcctgtgttttcttcaagtggtttcatggtttggggtcttacatttaagtctttagtccattttgagttgatgctgtatgtggtgagagataattgactactttcattcttttgcatatggttatcagttttcccaacaccgtttattgaagagcctgacctttccccattgtgggttcttggctcttttgtcaaaaatcagttggctataaatatgtggttttatttcttgggtctctgttctgttctattatctgtgtgtctctttatgccagtaccgtgctgttttaattactagagtttagtatattttgaagtcaggtagtgtgatgcccctagctttgttcttttagctcaacattgctttggctattcagagtcttttgtgaggataatgttttcaaggttcacccatgttgtggcatgtatcagaactcgatttctttttatggctgaataatattccatttgtttatattatatatatgccatatttatttattcatatgttgatggacacttaggttgtttccaccttttggctattgtgaataatgctgttattaacattggtgtacaagaatctgtttgagttcctattttcaattcttttgggaatatacctacgtgtggacttactagatcacatggtaagcttttagtttagctttttaaggaactgctaaaactgtttttccatgggagcagtgtacaagtgttccagttctccatatgctcaccaaaacttaatttccttttttaaaaattatagctatcctagtaggtggtgggaagtggtatcttactgtggttttattttgtatttctttaatgactaatgatgttgagcatcttttaatgtgcttattggccattatatgtcttctttgggaactgtctattaagtcctttgcccattttttaattgagtttttttttctgttgaattgtgggagatctttatatattctgaatattaaacccttattgggtgtatgatttgcaaataatttctcccattttgtgggttttcttcactttttgatattgttctttgattcacttttaaatttttatagagtccagtttatctgttttttcttttattacctatgcttttggcatcatacctaattcccaaatccaatgccatgaagattttctgttatgttttcttttaatagttttatagttttactttttctattggagttttaagtaaattcttgtatattagtgtgatacattttaagttatttttgtatatggtgtgaggtaggggtccaacttcactcttttccatatggagatccagttgtcccagcaccacatgtttaagagtctattctttccccactgaatggacttggcacccttgtcaaaaatcaattggtggtaaatgtatggatttactcctggaatctcaattctattctattgtatttatatttctgtccttatgcctgtaccacactgttttgattacagtagctttgtagtaagtttagaaattgggaaacatgagtcctccaactttgttcttcttttcaagattattttggctatttggggtcccttgcaattctgatgagtttgaggatcaccttttccatttctgcagaaaagccttttgatagggattgcattgaatctgtagataactttgggtagtattgacatcttaacaatattaagtctttctatgcataaacatgggatatctttccatttatttgtgttttctttaatttctttcagcagcattctgtagttttcagagtacacgtttttcacctccttggttaaatttattccttggtattttattcttttagctgctattgtaaatgcagttactttcttagtttcctttcagattgttcatttctggtgtataacaacagctgatatttcaacgttgatgttgtactctgaaactttgttgaatttacttattagatctagtagctttctttgagatttttatatgggattatgtcatctgtatatagagatagttttacttcttcctttccattatggatgccttttatttcttttccatgtctaatttctctggctagaactttcaatatgatgttgaaaagcagtggtgaaagtgggtatctttgtcttgcttcctatcttaggtggaaagctttcagtctttcaccattaagtatggtgttagctgtgggttttcataaatgccctttatcatgttgaggaaatacccttttattcctagttttctgagtttttatcatgaaagggtgttggattttgtcaaatgccttttctgtgtcaattgaaatgatcatgtatttttcctcccttatcttaatgtaatgtgttatattgattaattttcttatgttgaaccacccttgcctttctggggtaaatttcagtcacttatgttatatagtcctttaaattgtgttatcttataacagaatcactctgctactgttttgagcataggccatagggaaaagcaggtaaaaggtaatatggcttgaaccaacattgtagcagcggaagtggtgagaggaggtcgaattttggctttgttttgaagatagaaccaacagtatttgctgacagattagatgcagaatgtgaaaggaggagatgagtcaggatgaatccaaggcttttggcatgagcaaccagaaagatgaaggtgacttactaagatgggaaatatacaaaaggagcagtttggggaaactttatatctattgagtggaatatgccaattagagattcaaatatccagtaaataattggctatcaaagtttgaagttaagaggaatggtctaggctgtttatataactttggaagtcattagtgtataacagctaatttaaaagccagcagactctaagggagtgagtgtagagggagaagagtagaggtctgtgacttgaatcctggaatgctgtgatgtttagagattggggaggtaagaaggagcagcagagtatactgaaaagggattgttatactgaaaagggattgatatagatggagactcaagaattatcacagaaacctgataaaatgtttcaagaagatgggtgtgattaattgtgtcacttactgccggtacattgactcagatgagcgttgagaattggctataggatttgacaacataaaagtcattggaaaccttgacatgagcccttttcgtggagtggagtggttacagtgggtttaagagaggattaaaggagtggaaacagagatgctattatagatgactcgtttgagtagttttcctacaaaggggagaataataatggagcagttagccaaaagttgagtttttttttcttcttcttttttttagttggaaaaaattgcgtatatgttgatgggtcttttctggcagaccagtagagaggaaaaagttgatgatgtaggagatgggaaaatgtctttgagtagatgtcttcgagaaaatgtctttgagtagatgagaggtttgcacacatggagaggttggatgtaggagtactgatagttcatccatagttacataagaaaaggtagatgtattagagttctcctgagaaacagaaccaatgggagatctttatatctctgtgtccatctctatctgtatttctgtctctgtatctatgaagagattataaaagttttaagatctgccaggagacatacccacgggagctaatggtatagttccaggccagttgtgaaggcctgagaaccaggagagcctatggtgtaagttccagtctgagtccaagtctgaaggcaggagaagaccaatgtcccagctcaaagacaggcagagggagcagatcttcccttacttagcctttttatttattcaggccttcaacaaattgaaggcccacccacattagggagggcaatctgctttactcagtctactgaatcaaatgttagtctcacccagaaacatcctcacagacacacccagaataatggttagccaaatatctgggcaccccatggcccactcaaattgacacataaaattaaccaccacagtagagtatatgggtacaaatataattatgtgatatagatttcagggtaagagcctgtggaaattcatttttgattgcttctagtgaaatcggaagcaagatcatcagctaagagtgacgatcggtggaggagatatgaagtttaagtggagaggagaaggtataaaatagtcttaggaggggaggatagtaaatagattagggaaaagttgtaggattgccaggaagtagtaagggcccacttgaggctggtggtcacaaatttaaggtgagaccagtcaaaatggttgtgcttttcacctgctgcattcattcagctgcataggtacaggcacagagtaggtcaagagttcttttttattcggggttagagttttgccaggagatagtaataaagccagaagggcaatgaatttgagggagtatgcaaggaagtggctgttaacttggagtttaaactagtcaagaagagaattaaggactgcccaaggggtgaggacaatgatatggtagcagggcccttaaaagccccagttagatgaaaagattgttggaattgagtttctagagggaatgaacttgaaaaacaggaggtgttggttggagagtgggatatatggaattgagattatggaaggattcagtcgttggtaataacatagtatctttgtaggaataaataggtggagcaggatgcagacaagatcactggaggagggctggtcagaagactgggaggcactatctcccttggatattatacatcaaagcttgtgatctactagacaagtagtggggaaagggtaggatatagatattaatggctatagttttgatggtgatggtcatggtgatgatgatggtccattaacactcaactcaaataccatcaatttgatttatatctaacaccacaaagttaggtgttgagttacatgtggttatattgtaactaatagtcagcccttcatggacttctattctttgatgagactcttcttgtaggagtagtaggtgccttaaagcaccttttcatagttgtcagattgaaatccttcaccagtgttttaggttaaccctgttactgtggaagtttctcttggctttctgtgtgggctgcttctttgtctagttttaccttttggggttagcatactattgtgaataatttattggtgagaaggtaagcagagaagtagagtactctatgacctagtaatttcatatctaggaatctatcctatagaaatgataggaatgccttacaatacccacatatccacaagggtattcattgaacgttatttttggtgaaattcgcaagcaacctaattatcatcaatagggaattgttaaattatgatagataaaatggaattctattcagtcttcaaaaagtcagatcaagaagtggtcttacattttaattatcccatcctgtcaacaagagtgtcttcagttgcaagtaatggaaaaaccattcaaactgacttcagcaataaaaggttatttattggtctgtttcatggagacatctgaggtagagtggccttcaggcaagttcactcagggatccgactatttttctggccttattcttggccctcttctatgaaaacaccttcagggtggtttcttgtatgcttgtaagatggctacttgcatcaaccatgaccacatctagcaggagcaaaagcatcctttcccgtaccagaggagagtcccgaaatttgttgcaattggactgccttggaagcaataattatggccaggagatggaggctagagaactgagacctgatcatagctcctatccttgaatcagttgtatagcaaggggaattggattttccttaagacagttggatttcacctgtagtcttggtgatgaggtcagttccatccataaaactttgctgttacacattttgggatggggtgaggagggctgaatggagattaggatgctattgaaatttgctgtacacaatggatcattatcgtcttctttcttagtgttaaggtaatcagcctctttttcctcctcctatgcttgactttactaaaaccatgagacatgtttaacctcaggactccaatttgaaaaaatatagactgttatttactttattacttacagaagcccttcatactactctcagcaagaaagaggtaggcagggagtgagggaggggggatcatgcttactgagaaacaaactatcgagtattgaaactcccccttcatatgcctgacctcagtcccattcagttaccagtaggggcccctattaattggtacctcaccagcttttgctgttcgttcataaaactgagtcattgaagtacagtagaaaaataattggactacaagataacttatttccttccataattgcaaaatatctgatttttcttcttgtttgtattatgtaaacttaccctgtctgagggtcctcctggattgttctttgcatttatatatacatagaatttcattttcttttttcttgttttttttttagacggagtctcactctgtcgcccaggctggagtgcagtggcacaatctcggctcactgcaagctccgcctcccaggttcacgccattctcctgcctcagcctccccagcagctgggactacaggtgcacgccgccacacccggctaattttttgtgtttttagtagagacggggtttcaccatgatagccaggatggtctcaatctcctgaccttgttatctgcccgccttggcttcccaaagtgctaggattacaggcgtgagccgcttgcccgaccttcttttttttttttttttttttttttgagacgttgagatagagtctcactctgttgcccaggctggagtgcaatggcacgttttcagctcactgcaacctccacctcccaggttcaagcgattctcctgcctcagcctcctgagtagctgggattacaggcgcccgccaccatgctctgctaatttttgtatttttattagagatggggttttaccatggtggtcaggctggtctcgaactcctgactacgtgatccgcctgcctcggcctcccaaagttctgggattataggcgtgagccactgtgcccggccaatttcattttctattttgaaatttaaactaccactgacacttcgttttccctctgttttacttagcatttatcttagagaataatcttaatatgtatagttctattttattcttttactggcagcttagtatgccatattttggatgtgtcattgtttatttacctattaatttaccctataactgcttcccatatttttgcttttacaaagggatgtaatgaacatcctttacatacgtctttgtgcatatgtgcaaatatttccataggatagatgtaattactgacttgaaggttatgcagatttaaaattttgatgccttctatgaaacatctttcaaaatggtgatgccagtttcttctctcgtaattactgcatatggtcaatcttttaaatttttgctggtaatgatatttcaaaattataaccagttttttggcctcatttcttgaataacttgttttttctcaaagataagaaatgtctccttcatcgtatgtcaaatttccatatttacatggatctatttctggacatggcaagttttatttatttattgtatgtatttacggtgtacaacatgatgttttgatacacatatacgtagtgaaatgattcctacagtcaaacaaattaacatgttcaccaccttccatagtctctgcagtcttcaaggttttctctatatgggattagacatgctatgtctgatctgtttttgtatttttacaccaattccacactaattttttttttttttttgactgggagtctcgttcttattgcccaggctggagtgcaatggcatgatctctgctcactgcaacctccgcctcccaggttcaagcaattctcctgcctcagcctccctagtagatgggattacagcactcgctgccacacctggctaatttttgtatttttagtagagatggggtttcaccatgttggccaggctggtctcgaactcctgacctcaggtgatctgcccgcctcggcctccgaaagtgctgggattacaggtgtgagccacctcacctggcacacactattttaattactgtagttttaaaagtttcatatttagtagggtgagtttttccttgttggtcttgtttttcaaaaaaaatttgctgctcttgagtattttctcttcccagtgaactttaatgtaaactcacgtggttcaatgaaaaattctgatgactttttttcttggtattgcttcttgagtgtattgatttaattaatatatttacagttttgggtctggctgtgccgaaacgcagtgtgtcttatccagtccttttttaactgtcttaataaaatttgctggttatctttaaaatggatcttgtatattttatgttaggtttattcccaggcaggttgtcatttttgctgttactgattttggatataaattttggatataattgtataatttggacttggatataattgtatttgattctgtcttatatataaaaatgagataggataataatttatcctaggataaaaataatttgagtatccttattttgcatctggtaccttacttgctcctgttaaacaaatagataaaattacttgtcttcaaagagatcctgtggaaaaattatttattttaggagactttggagctttgataaaaattaggcttatcttttgtaaaagctggttagtgatagcaatcagactcttttaaaggtgatttttttttctttcctttgataaaatgcttaatatgagggaggattaagaaagaggatggcttttgaacagtttcttcatggggaaataagaaattagaataatttcatgttctccaaaaaaaggagaaaaatgaccttccctcctgagcctacttcaagcctctgtttctttctgactctattgttctcatctctgcatttttccaatctcttctactgttagtgttttaggctagctcctcagtggagggcagaaattcaccttctctttagctgtctttgaaaccaagaagatagaggtatgagatcttcgtagtctgtagtaagaataatagaagccatcagaaaaaaatatcaaagctttgtagctgctcctggaagttttgatgtgaagcaggagacatcacctattggtacctgacttgcttttgctgttcattcataaaacagagtctctgaaatacagtagaaaaataattagactggaggataacttttttccttccaggaattacacaatcacaaaattgctgatttttcttcttattcatgttacataaacttatcctgtccgaaaagactgtatttgaacttactatgtaagatttgctttaggtaaatttatggctgcttccagaattgtgtattaattttccagtttcttttttaccagtctccacttttacctttccctcttccccctatacttaaattggtcttactgtaaaatttatgcgtttctctttctacctggcaatgctgattttttttttttttttttttttgaggcaaggtctcactctttcacccaggctatagtgcagtggcaagatcgtggctcactgcaacctcgaatccctgggctcaagcgatcctcccacctcagtctcccaagtagctgggactacagatgtgtgccatcgcacctggctcatttttgtattttttgtagagatagtattcgccatgttgcctaggctggactcaagccagcctcctgccttagcctcccaaagtgctgggattgctggcacgtaccgctacgtccagccagggctgagtttctgaatcatcattgcagcaagagaaattggattacctttagaccactggctctactgtgggctgggagtgggacaccttccttaaagcgcattggacattggctttgtgggtaactgatctttacctgaatgaaatttatcagtactgtattaagggtctagggtggaacggatgctagcaaggcaaccgttaacatccacttactgatgaatcctataaaattttatttcaggccatacgaagtaacagtaataaatataaaaggaaaaatagacaacctaagcaactttttaaattgacttacttgaaaactttccctgcaatttcccggtttataatggttgatttcagctgactggctatagctacttagagaacagaggaaattcattaaaaataatgaattattcagttgggtagtgaaatccagttataaagcacttcgctgtgccatggattcagttcaggtcaagtgatgttcctggtttatgggcagtgtggcttctcactatgacacagcaaagaacgtagcttttatcctttacccttgttactaactaaaattaatggcattttattgtgtttatttgtttgattccatttacagtttatttcacttggttttattagtacaaaattgtgctttatataatatttgacagttaggaaaaattgttagatacctataaagaaacaagtctctcaaaaatcatcctactacttttaaaaattacatcgtcttactacagttaacctagatgtgaatgggtagttttatttagcttttctggtttgtttgcttggtctgtttggagggaagttaagattagcagaaatgtagtaatagattcatgaaagtcttgaaagcttctttaattagagaatttaatgagggctttggcatgcattctttggtttttctctgttttcctctaccccttcttattctttttggttcattgaaaagtagaaagaaattctcaaaaaccgtacaggagaataccttataaatgatatcttctgcaataaactatagattgtatatatgtatatgtatctagatacacaatctgtgtgtgtgtatatatatgcatgtgtgtgtataaatgtataaattagttactagtatatacgtaagtataaaaactcaatgtgcaaggttacattttcagaaaatatgtaatataataaaagaaatcaagcccagaatttttaaaaagtttattgcgctttctgttaaaaatgaaaggctttttgactggaagctgcttctcagtaaaaataacataattgtgttggtgaagcccaaagattctaatgaaaattagggtattgacaaccaaacggaattgctggagtacttaagctgctttggttttgtaatctttctgtgtcagaatatttgaaaaacacttattaatccagtcttgtaacttatccttgaaatctcttttttaatattcttttccacacacatgaaaagttagatgagtgtatgaatttctgttgtcagactagttgtaaacctcctaaatatagtttctgcagtatagttaaagagaaagaacatcctggctaacacggtgaaaccctgtctctactaaaaaaaaaatacagaaaatgagccgggcatggtggtgggtgcctgtagtcccagctactccggaggctgaggcaggagaatggcgtgaactcaggaggcagagcttgcagtgagccgagatcacgccattgcactccagcctgggcgacagtgcgagactctgtctcaaaaaaaaaaaaaaaaaaaaaaaaaaagaaagaaaataggcccagcaaggtagctcacgcctgtaatctcagcacattgggaggctgaggtagggaggattgcttgaggccaggagttcaagaccagcctgggcaacatggtgaaactccatttctacaaaaaatacaaaaattagctgggcatggtggcatgtgcctgtagtcccagctacttgggaggctgagtgggaggattgcttaagcctggggaggttgaggctgcagtgagctgtgactgagcaacagagctagactctgtctcaaaaaaaaaaaaaaaagagatgggttttgaaattcagtactttttttgagtgaggtccaatgggtcagaaagaagcattggataaatgaatccattttctcttctctgtttgaatttgtaatttgaaagaatattctacctataaagtacttcagtgcttaattagctgtcagtgaatttatatatcttatctaattcatatggatttgctatttttatctgtacctacagattcctgacctctctaaggggatcccagtatactatagggaatgaggtataatagaagtaaaagacctatcactagtcctgtcatcattccaactcatgtgtaattatagtttaaaagaagtgacatcatgtgtattgctgtttatctttacattaatcttgtggtcaagaaagcaaatactataatatataataattatataatatcataagacaagtaatataataatgggaatataatcccattttacaaatgaggaaatgaaaatttagagaaataaagtgacttgtccagggtcacatggatactaagtgaccaagtgtcaaagcagaattttccaaataacttaaagataattcttgtacaaatatagaacgaacacatgtcatatgtgttgtgttaatgagggaaccagaaggatgacaacattggttcagagagatgcaaagataaatatagacattggaggaaaaagttggaaataagattgttaggttagatacaaagctgtgttataggccaataaaaaccatagactttgaggttatcttttttactggacaggattcagttacacctttatgagaccaaaatttattatttaacatgtggatattagagtctgagttttaaaattattagtaaatgaccgtcaaataaagatatgtcccctaatgaaatactgataatcgctgggtgagcttgtgctcctatatgacattgaaatgacatactgccctctctttgtcttctaagttttggatacttttttttttttttttttgacacaaagctgcattagaacctaggtttcttgactttcagtccagatttctttccactctacttcctgcttcttcatagtataattttcaacactagagcagtctgcataacttttgcaaaatcagctagtctttcttattagttttcctttgtgcaaagtgatgtagatacagctttcttcttcagagaaacattgtgaaattcaatgaatatttgtaaaatttgcatacgtgcccaatgtgagaaattgaaattattacttaagtattgcaactgttcttttaggatattttgtttgcaaatttcagagtaattataaatattcttgcatttttattgtaatcagtatttataaaacagtgtatttcatcacattaacctttacatattttgaataaaatagtattgaaccattttaaatagtaagtggaaatttttccacattaaacagtataacgggctaacagagttaagcattgcattatttaactaataattttttcctgaacttcagattattatctgtatgtgtcatataacttgacaattttttttttttagtgctttttaaaaagagtgggatactttattcagtttagccctcaagcaattaggcaagtcagttaccatggtaacagtaggtattaatttccttacctagttagaggttttatgaacaaagaaatctctgagttcatccaccaaaacccaactttctcttgagactggcctcttgagactggtgttaaatttgtctattttctagaagatgacactattctaagtggaaaatacggttctcttgaggtgaatttctactctatcaagagtgaagtagagtatggcttaaaagttaagtgattaaaaagctaccctttcttagctaatttggaatgtaattggtcttaatttttctaaattcgttctaaccaaaatcttattggcgtgatttctattgacatgaactagaagtgacttcagcagacaacttgtcccaatatctaaatgctgtcaaatagaatcacttaagatgaatttcttccaaaacagagttcacaattttgacagataatctcttagcatttaattgactagtattaccaaccttatggaataggtccactcgtttagctatcatgaggaccattttgcaactaacttatcaaaaagccttcaccaagaagttgcatatcttattgatattttagaatgcgattatggagattaaaaatcaccacaatgggttgttaataacgccagccttgaactttcagttttagagcattttatctgtgttctgtagtcaaagttggtaaggtgtccagtgggtcatgtttgacttgctgcttgtttttgtactgtgtgctaaatggtttctacatttttcagtggttgaaaagtcaaaagaagaataatattttatgaaatttaaataaatccaggtttcagtgtctataggtaaaatttcattgtaacgttgttatgcttaagtattgtttatgacttctttgctatagtgacaaacttgagtagttttgacaaagatcatctggcctgtaaggcctagaatagttactgtctaaccctttagagaaaaaaattgctggcccttgttctatagtatgaaaaaatatagccttgattattcattaaaaaattattttcccattttattgacatacttttgtcccctgattgttaaaaggaatgcatgttcttatagaaaagttggaatatatagaaaagtataaagaacaatatgaaaaaccatttgcaattgtgagataaccactaatgttttggtatacattgctccagacttacacacaaacacacacgcgtatttattttatacaattagagtctaattttttttttgagacagtcttgctctgttgcccagggtggagtgcagtggcaagatttcagctcactgcaacctctgcctcctgggctcaagtgattcttgtgcctcagcctcttgagtaactgggattacaggcgtgcaccaccatgtccagctaatttttgtatttttagtagagacggggtttcgccatatgcccaggctggtctcgaacccctggcctcaaatcatcggcctgccttggcctcccaaagtactgggattacacacgtgagccactgcgccttaattttttaatttgcttttttcacttgaataattataagaacattatttttaatgactgtgtagtgttctgttttatggatgtaccatacttaattatttagtcataatttattattatgaggttgataaacatgataatcagattgagctcaagaagctagttatagggttgcacaattaatgaatcccaggtacctcgctgggttgctgaggctgctatttttttcctgcctgtttggaacactgtgtttgggaccaatgaggcaaaagaaattgaagagctgccattttcaattattctattagaagatacattgaagatttgtcaaatgacatagacacaacactaatccagaagattatttaatcaaaaaggcattcatttcagatatgaattcataaacatttgtaacgatcctcagtttgaagaccatatagaatccctgaagaactggaagacactatttgcttggcaaagagaagtccccagaccaactggggatgaaatattcaaagagataaatgaatactttgaaacatacaaggtactatggaaaaagagtggaagtttgggacaggtaatgacaggaagatataaaagctttacattaagttcaatctaaaactttattccaagtaacaggttgtcttattcatggagaagcagttgtaaattaaaacttgcctgtggtttggaatttcacattaaatgattacattaaaaattcaaatggtgaacctaactaaatccaagctcctacagtaccttcttttcacctttaggtgaagaaatgcggtgagctattttattactgattatgtggacagtccaaaggaaggttcataagcgaaaaggaaaaatttaaattattccatgtgagcgattcttactttgcagatttgttgaagtgtagttactggcttcaaaaagtggtatccttaactgacattttgaacacttgaattcactcaataaaaaaatgcagtgatcatgtggaaaatacattaaggtatatgacagagtttatggattcagagcaaaaattcagctttggaaaagtgaagttaaaatggttttttaagtgatgtttaattggtgttatttgaatcctaaagaagaattaatagtactagtagaggaaagtcagtgtgtctgtgacaaagctttagtattattttgaaatacttgatataaaaaagttcacgtttactcaaagcttacttaaatcatcagaataaattaacatgtttcttaattaaagaaaaggagaagctattagacttaaaaaatttttgcacccttgaaatacatacaatttgaagagattaagttgttggaatactggttaatggtgaaaaaggagttttcagtctatgaaagcaaagccttctcctttgccatttgcttttttgtagtggttgctatgtagaattcgaagaaaatattgttaaaaagtcttggtcaggagtagagtgtagcatgaacccaatgcattttaacgttaataatgaggaaaaagggaatgcatgataatttcatcaagtcagaaaaaaatggaaaaagaaaaagaggaaactgaagaaagtaactgatgaaagtaaggtgaaagggaaaacaactttttataccacctgtgaatgagattaattttcgtttccatactgaaagacaaatatattccaattaagccattcaaaataaaaaacaatttttttttggtaagagatgggatctcactatgttgaccaagttagtcttgaactcctgccctcaatcagtcctcctgcttcagcctcccaaagtgctaggatttcaggcatgagccactgtgcctggccaaaaccaaaattaagcaacaaaacaacaacaacaaaaattccagacagcctttaaaataatgataaaggttgaaaaattgtagatagtggtaggtagataagatttcaggaaaagtccaaagcaaatcataatacgttattttaaaggggggtttaaaatcctttaaaggtacaatgtgaagcattatgaaatgataaaatacatgttttttaaaaacattaattttattttaagttccaggatacatgtgcaggacgtgcaggtttgctacataggtaaatgtgtgccatggtggtttgctgcacctatcaatctgtcacctacatattaagccccgcatacattagctgtttttcctgatgctgtccctcctccaggacccagtgtgtgttgttccccatgtattctcatcgttcggctcccacttataagtgagaacatgtggtatttggttttctgttcctttgttagtttgctgaggataatggattccagttccatccatgtccctgcaaagtacatgatcgtgttcctttttatggctgcatagtattccattttatatgtaccacattttctttatctagtctatcattgatgggcatttggtttttttccatgtctttgctattgtgaatagtgctgcagtgaacatgaacatgtgtgtgcttgtatctttataataaaatgatttatattcctttgggtatatacccagtaatataattgtataacccagtaataggattgcagtgtcaaatggtatttctggttctaggtctttgaggaatcgccacactgtcttccacaatggttgaactagtttacattcccaccaacagtgtaaaagcattcctatttctccatagccttgccagcacctgttgtttcttgattttttaataaacgccattctgactggcatgagagggtatatcattgtggttttgatttgtatacaaaaaagatttgtatttctctactgatcagtgatgttgagctttttttcatgtttgatggttgcataaatgtctttttttgagaagtgtctgttcatgtcctctgcctactttttaatgggattgtttgttttttttttcttgtaaatttgtttgagttccttgtagattctggatatagacctttgtcagctggatagattgcaaaaattttctcccattctgtaggttgtctgttcactctgatttgctgtgcagaagctaaaagacatgattttagaaaaagacatgtcaaagtcatacatgctcaacgacatagcgagtacatatgtaaataaaaaattattttatgctgtgaatttgaccgaaaataacctttacctcgtcaggaattacaatcctcacgtatggtaaaggatttccctattgcaaattattccacaacattaatgttctgtgtgctttttatctatcccaagatacaagtaaatttgacaaagatattaggtttgtaaacaaatttacgttcaaatctttgcctggaagtatctagatagaattttgcatgcaaaagagtatttacatctaaaaaattacatatttcaaattaaaatgattttagtgttatagatagaaggaaagagttattgaagtttatttctgttttggcagtgtaaatgaattacttacaaaattttagaagtctacaggtgtttttataaagtttgtgttatttgtggaaacctcagttttctggcattttgccaatgaggtctactctaagtatagcagaaatttgttttccagctttataaatatatattttaagattaagaactgattttacttatataatctgggatcaacttttggcttctcctgtcaaggattttgaatttgtgacaaaatatacacttattgataaccagtgacatatataaaatgctttacaattaataaagcatatgtattttacatattttttcactacatatgacgcatgtggcaaccccaagagttgagttgtacccatcggcaaactttgatcatgattctgtgaatataggcaagcaccaattgcaggtagaacattctttttttgagtcccaaaccgtgagaaacaaattacagaaatgtacctttcttttgcattaggacacgttgtagttttgtatgaacactctagttttaagcagtatgtgcaaaaacattgcacaaaggatttgtgtgttgattttgggactcctgtattattaattatgtggtttatttgactaccccacattttcaagcataaattaataaatccataattccaggcttattaacaataaacaatctagatagttgaactctttcttgctaacattttctagatatggactgtttggtatttttctactaataaagacccttagtaagctgccttctggtttgatgtcattgggatgtttactgggaactttggtggagatcttgcagtctctctcccccagtggtgaaagaatgagttacaaaccagctttccttcccagtgtacaatagcgatggagtttgttctatatggaaaatttgtttgataaaagtattctttaaaattttttgttccataaattatcagtattttcagtttctgattcatgcttgggatagttgctgcatattgtttaattttgtcagaatttatattgttaaatatcaaatacgacagactaccctcaaatcataagtagttaatgtaattaacatcctgtttcatcatgagactcttcagtgttacattaaaaactgctacctcctgggccgggcgtggtggctcatgcctgtaatcccagcactttgggaggctgaggtgggcgatcggatcacgaggtcaggagattgagaccatcctggctaacatggtgaaaccccgtcgctactaaaacatgcaaaaaattagccgggcttggtggcgggcgcctgtagtcccagctactcaggaggctgaggcaggagaatggcatgaacccaggaggcagatcttgcagagagctgagatcgtgccactgcactccagcctgggcgacacagcaagactccgtctcaaaacaaaaaacaaaaaacaaaaaaactgctacctccttattacaaataggaactaaagttgaagtttgaggaatttgctaagaactaagccttgaactaaggctattttatttgagtatgagtcatatcagggtacggatccattttactattaacaaaacaaatatgttctgttttttttttttaaatgcacacaccacgtttgagagattcttattcactgtattttctttaattatacttgaattttggtttacattgaggagtgccctcaaagatattaacagatttttaaaaaatcctctaaaaaactcattcttagggaaatttgttcacttactaggtgaggagcaaaataaaaatccttaatatagaagagctattatctgtcttcaaaattaagtctttgagtagatttgtgaataaatctaatagttttgctgaatttacttagatcttaagacagaataatcatgtagaaaatttaaaatgtcaggaattcataatgattcatatacccaaggattttcattgatagtgaggtaaggttattcttgagaaagactcaaagtcataaaataatagaatttcgaaactaccagaattatacaagtcaattaaaatgactgatttgttttaagaggaagaaatactaaatgtataattattagatgcagcatattgtatctgttttgttttgtgattctagctcttataacctatgcttggacctaggtgtcataacttactttaaatatgtatgtttggttttcattcatattgacagtactacctctcagttttctttcagatattgttttgtatttacccatgaagacattgttttttggactctgcaaataggacatttcaaagatgagtgaaaaaaaattggaaacaactgcacagcagcggaaatgtcctgaatggatgaatgtgcagaataaaagatgtgctgtagaagaaagaaaggtatgttgttcattgactattctttcgggtgagaaatttaatttatatttgactgtgcaaagagtcagttgttacttgtaaacttcaagtcattgtttaggtcagagttgctgttgtctaaatgcaccaggacctagttgttgaaagggtaaactggaataaactttaattgggtttacaaaatgagaattcttactgtatattttctctttttcgggttgactttaccagtttgttctagttcagataatttagacaacattaactttgttgaattttttgtttgccagccggtcttcagcattttaaggcaacattattattacagttgtaatacgaatataattaccagagaaaaaactcaggaaaataaatgcttttatgaaaatgggattagaggtttgaaaataaacttgttaggagaaataatttcacaatgggatggttttttctttgttaagttttctttatgacttcattagtttataaaacattaattgataaaacttagaactataaattgaatgcttcagtgaactttattatttcagtgaacatttgttatttgatgtgaactttgtgcctgttttgaaatttactaaactcaaggcatgtgttcggaagagtgtttttgaagatgacctccccttcttagaattcactggatccattgtgtatagttacgatgctagtgattgctctttcctgtcagaagatattaggtaagtgatttgaatttcctgattttatttgaatttggacccttagaaggtactattatggtaatgtttgtgaatatactgagttttacaggtgaggtgtgttcaatagataattatttctatgtatacactatcaccaagttttacatttcaaataaaagtcactgaattaatttgtaatctgtcagtttgttcattcataagcttttctattacttcagacagtttttttttaacttttttaatatatgtgctgctgaagcgagcacgacagttttttaactttcagtacttaagatgttatatatagagctactgaacatactgtgtttattttaccaatttagggaaaaagtgcaaaaattatttaacctttaaatgcacctttatatttcattaaaaatatcaacatagtaatattgaataatggctatgatcggctctgttgtgtgtaattagtaacagttgtagcaaatgatccttaaaaaatgttctaactaaacattagaggccaggcgcggtggctcaggcctgtaatcccagcactttgtgaggccgaggcaggtggatcacaaggtcaggagattgagaccatcccggctaacatggtgaaacaccgtctctactaaaaatacaaaaaattagccaggtgtggtggcgtgcgcctgtagtctcagctactcaggaggctgaagcaggagaatcgcttgaacctgggaggcagaggttgcggtgagccaagattgcatcactgcactccagcctgggcgacagagtgaggctccgtctcaaaaaaaaaaaatccaaaaaaacaaccccacaaacaaacaaaaaacattagaaatgtctgttagtacttttaaaggttgccttgtaaaattaggactgcaatagtgcaatctaaggctctcaaagcataaaacaagtaataaggaattcattcagatattttccgaggtggttatacctgtcttttaaaaaaaaaattttgttatatattgggttaaaaaaagcagaggtgctgggcacagtggctcatgcctataacccctacactttgggaggccaaggcaggaggattgcttgagcccaggagtttgagaccagccatagtaagacccccatctctacaaaaaaatttaaaaattagccaggtgtctgtggtcccagctactcaggaggcctaggttttgggcccgagaggttgaggctgcagtgagccttgatcacaccattgcactccagcctgggcaacagggcaaaaccctgtctcaaacagacaaacaaacaaacaaaaggcagaggtaggttaagctatttattaatggtcttctactggtatagatataagctagaaataacattcaagtgtttttacttttactacagttatctggccactttgggactcattatactgaattagtttcacagaggaggtaaaatctgttgtttatgattacatattaactctaccattttaccttcagcattgctgtagtatgtcatatctgaaggcaattagcacaagtgacttgaagaattgtagttttgatgacttatatgtattttataaaaggcaggcagagtttttgtgtttgctttcccctcctctggacactttaaatttttgctaccacaggtttccaacaatttgattatgatgtgcccttgtgtaatgtggttggtgtttatttggcttggagttcgttgaatttttttgatctgtgtgggcttatacctttaatcaaatttgaaaaatgtcttcagatcctttttcctcccatcctgttattcttttctctttctgggactcttagtacacacaagtttgattgcttgatactgtgtcacaggccactgaggctctttcctttcagtcttttcttctttcttcctttttttctttctgtgcttcattttgaatagcttgaatagttttgtttcctgtcttcaagttcacttatatttttttcttctgtagtgtctggtctgtttataccatcctgtgaatttcttttttagatactacatattttgtttatctctagaagtcccatttggttcttaatttttttttccattttggctctcattattcatgtttctttcaaaattcttgaacatatttagcatatttttaatagctgttttaatgtacttgtctgttaattccattattctagggtttttttctttctattggatgatttttctcctgattatgggttatattttcctgtttattcctacagctgttaattttttttttttttaattaggcattgtgatcttactttgtggaatgttagattttattgttttcctttaaagaaaggaactttgtcagacatctaagttacctgaagatcaactttatgttttgaagcttgttttcaagcttgatcagggaaagtctacgtttgcctttagtctaaaggtaatttagccctataataagatgtgacccttctggagtctttgtagactgcctctggtgatcaacgatctcttctctgacttttcagaacgttaatgcctcttacctttgtgtaagtccgtcctaagaatcattcagcttatggttgtttgcccagccccatagagttttagtctatgcatgcttgtcttcgtattctgcaaagaccaaaggagtcccttagggagatttctggagctcttttcctgcctagcttcctcctctccagaactctgccccgtgagttccaggtccttcagcttccagggctctgaactctgtctccccaactcagtgctctccttgggattcttctccctgttctgttgtctgcaatgggtcccaggaagaatgtggggcaactgtaaggttcacccttcatttcccttcccttagagatcatagtcctgtactgcctgttgtctagtatctgaaacagttgttttatatgttttgtccaagtttagatttgtttgtggtgggagggtgagtctggcctcccttgttatatcatgttggcctgaagcagaagctgagtttcttttattttttaaatatagtttcaatttttaacaactattaaataggcaagtatcaacaacaatagataacaatataatagatatgcatattcctcccactttatcaaatcttaattttcttcaatttttttttttttttttaatagggtctcactctgttgctcgtgctggagtgacagtggtgtgatcttggttcgctgcaacctccgcctcttgggctcaagtgatcctcctgcctcagcctcctgagtagctgggactacaggcatgcaccatcatgcccagataatttatatatatatttttttatagagatggggtttttgccatgttgcccaggcggtctcaaattcctggactcaagcaatctgcctgccttggccccccaaagtgctgggattacaggcgtgaaccactgcgcctggcctgttttcttcagttctttattaagaaatgaaacagtaaaatacagctgaagccccgtgtttgttctttctgattctccctctgtgcccctctgagataacttctatgagttttgtgcatttttttttctttttaataaaaacagggtcttgctctgttatccaggctggagtgcggtggcgagatcatactcaatgcagcctcaaccttatgggctcgagtgatcctttcgcctcagcctctcaagtagctacaactactggtgtgtgctgccatgcctggctaattttttatttatagtttttaaagacagggtctcactatgttgcccaggctagttttgaactcctggcttctagtgatcctcctgccttggtctcttacttaaagcactgggattacaggtgtgagccactggctgctcacatgttttttataatagtacttaataattttatgtctgaaaatattatataatgttattttgcccatttaaaaactttaaaaaatgctaacaaactgtgtactctgtaacttgtcttttttactcaacactatgtttttgagaatttttcttgttgatctgtgtagttccattttaactgttatatcttactatgtttcattatgcaacagttggttcaatccattctcttgttaatggaaatttagtttgtttctaatttttgccagtaggaacagtgttgcaatgcatattcttaaacatgtctgtacacatctgagggtttcatttatttgtgacaaaacttgccaggtcatagtgtttatgcaccttcaactagatattgtcgttgtcaaagtttttttccaaaaggattttaccaatttatacatgaaccaccgatagatatcctcttaacacgtggtattctgaaacttaatttttaccaatcagatagatgtgaaatcacgtagacttagtttgcatttctttgacttctagtgagaagtagtgtcttcacatattttttggatttttaaaatttattttttatttttgtttttcttagagacagggtcttgaacttttacccaggctgaagtgcagtgatgcgatcatagctcacgctaacctcgaactcctggactcaagtgatcctcctgcctcagcttcctgagtagctgggactacaggtgtgtgccaccaagcccagctaatttttaatttttttttttgtagagacatgctgtgttgcacaggttggtcttaaactcctagtctcaagcagtcctcctgccttgactttccaaagtgctgggattacaggggtaaaccaccatacctggccatatcttttggatttattggtcatttggattttcttttgggaattacctgttcatatttttctccatttttctgctgaataatttgtcttttcttacttatttttcaagaaattttacatattttctggctgttcattgtcagttgtatgtgctccagataacttgaacagtctgtggttgccttttaatttttgaattatgtctttagttatgcagaagtttaaaattttaacataaattaatttacactatttttctcactttagcatgagtctatcagatggggatgtggtgggatttgacatggagtggccaccattatacaatagagggaaacttggcaaagttgcactaattcagttgtgtgtttctgagagcaaatgttacttgttccacgtttcttccatgtcaggttggtatctctacatttcatttttatatggctgataattgtaatatgtcaactttatccctataaaattaagttcttttattagctggccgttctctcattatctcaaatttatttaagtatttatgttctacctgattcactcacattccttgttttatttaattttcacaacatacctgtgaggcattgacattttttctgttttagagaagagaaaactgaaattttaagaggctaaatgaccaggatatgtactgctattgctagcaggagtggcattcaaactgattattttttcttgtcatttatcaatcaggactgtttgctttagttaagaaatactcaaggtcaatgtgtttctgaatttaaaattactgttaaatacaaatttatacataaacatggtatgtataagaagtaggacataaatccatcatacttgacagaacttatggaaataacaagaaaatgttacagtttttccccagggattaaaaatgttgcttgaaaataaagcagttaaaaaggcaggtgtaggaattgaaggagatcagtggaaacttctacgtgactttgatatcaaattgaagaattttgtggagttgacagatgttgccaataaaaaggtaaaagcaatatatatataattttcatgatgaagattattttgtgttacacagaatgtactttctatctgaatgttagatttttttttgaaaaagcttgttatataatgtttttgtagcaataaaaaagttccaagtgaatgttctttaatgaaaacctttatttatttatttatttttaacttttgtttcaagatcggggtacatgtgcatgtttgttacacaggtaaacttgtgtcatgggggtttatcatacagattattttatcacccgggtattaagcctggtacccattagttatttttcctgattttcttcctccctcctcccaccctccacctcccacagtgtgtgttgttcccctctgtgtgtccatgttttcttatcatttagctcccacttataagtgagaacatatggtatttggttttctgttcctgcgttagtttgctaaggataatggcctccagtgccatccatgtccctgcaaaggacatgatcttatttattttttttatggctgcatagtattccatggtgtatatgtaccacattttttttaatgcagtctatcattgatgggcatttaggctgattccatgtctttgctattgttaaatagtgctgcagtgaacatatgcgtgcatgtgtctttgtaacagaatgatttatattccttttggtatatacccagtaatgggattgctggggcaaatggtatttctttctttaggtctttgaggaattgctacacagttttccacaatggaaagcctttagttctaatccatgtcttggcatagagtttcttttctttttttttttttttttgaggtggagtttcgctcttgttgcccaggctggagtggaatggtgtgatctcagctcactgcaacctccacctcctgggtttaagtggttctcctgcctcaggctcctgagtagctggggttacaggcatgcaccaccatgcctagctaattttgtatttttagtagagacggggtttctccatcttggtcaggctgatctcgaactcctgacctcagataatctgcctgcctcggcctcccaaagtgctgagattgcaggcgtgagccaccgcacctggccggcagacagtttctttttttctttttgagacagagtcttgctctgtcgcccaggctggagtgcagtggtgcaatcttggctcactgaaacctctgcctcctgggttcaagcgattctcctgcctcagcctcccgagtagctggcactacaggcgtgccaccacacccagctaattttttgtattttttttagtagagacgaggtttcaccgtgttagccaggatggtcttgatctcctgacctcatgatccacctgcctcggtctcccaaagtgctgggattacatacagtttctttaagcaagccttctcttttccttcctcccagttcttggtactctttcactttcatatatttgcaaatgtaaaattgtgttttaggtgtatatttttaatccatgtataccagtaacttaaaaaaaaatttttttttttttaagggagagcataatggagctcttgtgatacggtgctcttagtggaagtttggctatcaattccatcacctgtatttcacatattttattaatgaagttcttaaattaaattctcatatttagccaagtattcatttggctgggaggtagaaagcctactaaccaactttttttcatgaacaatatttttaaagtccaagatttttaatacctacattagggaaattctagaattaaattcttacaatgtggactgcatatgaggcttttagtgacagggaatttgttgaaggctatctgtgggttgtattttggtataacatttcctaattttatttgtggtatgttcatttgatatcatttggtaatacctgaaaacaggaactgattttactgtgttgctttttcatcatttctagctgaaatgcacagagacctggagccttaacagtctggttaaacacctcttaggtaaacagctcctgaaagacaagtctatccgctgtagcaattggagtaaatttcctctcactgaggaccagaaactgtatgcagccactgatgcttatgtacgtgcttaaagatctttagaaattgtgatgtgttttaaaaacattattataaatgactttagaaaaattttattatagtagtggcagaaactctaccaaaatattttatatcaatttggcattgaaaaatgcttaggaagacatttagtgaaactattcattttcgatattaattagcaagtaccaatcaacagattgttcaatgctagtttattttcattgtcatgaagccaaattaatgtctaatttgtatgttaaaaaatgtgaacttgctgaaaacatgaaaggctaataaatccaggctgagcaagcataaatagtactgatgatggatttgatatataaacaattcagaatgaaaataattatagtacagtttctattttaaaactggccttatttcttatatataaaatgtggtgaaattttagaaaaattgcctccaaatttagcttgttgctgccattagatatatttttatatttacatgtttgtatgtagtgaaatctgggcttatctttatatatagcactattgtgtgttttttaagaaatgtattttattccacagtgaatttgttttctcctaactcatgctttcatttgtagatgaatattttattgtttctcctttgcatctatcaaaggaatggaaactcctttgaattgtaaccagcaaacaattcacttttgttagggaaattggatgataattttcctttaaaagataccgccaaacttgagactaacattctcagctgatttaagtaggatttctcttactagattgcattttgttagattccattttaagttattttatttggatattgtgtgtaatattgagtgtgaaaaagtgaaaacaaacttttaaggctcaggcacctttctcaattttcacaattggtatgattattaaatgaggacatattgatatttgtgtcacataataggttgaattccatgtttgggtgctttgtgaatcattctcttcgatttttctgaagatgggacttactgttttatttcggtgatctttagcatactttttaaatttttctgtttttttataggctggttttattatttaccgaaatttagagattttggatgatactgtgcaaaggtttgctataaataaaggtatgttaagatccataaataaaatgtgaattcactcttttgtgaggtttatctccaaaaaaggcaatattcacatatttgcaaagcatttagtactataacttcttgaatgtctgagcagtcctgacattagggtgggatccatcagggcccaagatgagtgtttcatctttgttacttgtggcaaagcagcccttacttcttttactttgtagcattgctatgtatttggcttctagagttggggctttgtggctttcttattgcagtgacacaaccagctttctcctagtctggagattatacatccttgctataagtatttaaaatgctttctatataatgctttaaaacatgtaagatggcttatccccaagatggtagctaataaacactaagtgataaagtaggtaaagatctatttattcatttattaaatattgttggtcattttacagtgctttctaacatactgatttacatttctaattttcttctgtcatttttctccaaaaataatggtcatgtcatccaacctcagtgctgtttttagaggtcttgataagccagtgagagcagaaggagccacgtagtagagtgggtgagcccaggctttttgttgcacagaccaatgtgaatcccagccatgtgacctgggatgtacctgtttctccaaacatggaatgtagatactagcataatgtccgttttaccgttttatagaataattgtgaagacttaaagggacaaactattcgaagcatctgtattgatataaagttatcactattctcgtagcttccttttggagattttaaatgattgtgtttgttaagatgttaattaaattaggccattttgctaaatgctcttaaaaatatggcatgactgcctcatataaaatgatatgatattctttataattgtcgttgagcctctgtgggtggcaggccctcctttatatgttaaggtagaagagtctttattcttacttctcctccctggagagccacttcctatgaatgcctgctggttctctgtagtcagaggtcttgtggctgtaacttagagtcagtctccatatccctgggttctgcatctgtggattcaaccaaccacagattgagaacattcaagccaaaaaaaaaaattcacagttttaaaaaaggaaaagttgaatttcttgcatggagtaccacattgaatctatatgaatgaagtgatgcgtaggcattttataaggtattataagaaatccggagatgatttaaagtatacaggacaatgtgtatagattatatgcaaatattgcagcattttatataagagacttgatcatctatggatttgatatcagtgggagggaggttcctggaaccaatccctcaaggatacagaggaatgactgtatgttaattaactgaggcaggtgatcggttttttaagctgattagggaaacagtatataagaacttacttaactcataataaaactaaaattcaacaggggagagttatgattttttggctttatggttgtggaattgcatgtaggttacatgtacaattttgttacatgtgcaattttgatgaaaatgcttccaaggaatgtttatgatatttttcactaaagtaacatatattaataacacagtactggaagtcctggtatctgtgtacttgtcattgtaatgctacattatttgaccttcactttttttcccctttattacattatatgtgtgagtatattgtgacatcttgactcagattccagtgaattgtattaggttggtgcaaaaataattgtggttttggtaatttttaatggcaaaaaccacaattacttttgcaccaacctaataactaagattaccatctttttttccttccttcctcccttccttcctttctgttattcagccagaagtatcagcatcactgttctcttattttcttcatgtacatatggatgatattttcgaatgaccacttttctcttttgctttttattattagactgtttttttcttcttgttaaaggataaaaagattagaacataaaaggatatttacacattgtttccccattgacttattcccaagatggtagctaataaacaccaaatgatatagtagttaaagatacattgactcatttattaaatattgttgagcattttacgatatgggaataccgtagtgaacaagccaggcatactctgtttcctgaggggcctacagttttattggggatatagatgagtgaagaaagcaattgcagtgtagggagatgagtcttacgtcatgggaaaacaaggtgctgtagttgacacaccgagaggcatctgacacattgggggaaatattctagaatatttcctggagaaagtgcaggtaaaagccagacctgaaacctgagcaagagttagctaaggccaggtgcagtggctcacgcctgtaatcctagcactttgggaggccgaggtgggtggatcacctgaggtcaggagtttgagaccagcctggccaaaatggtgaaacaccatctctactaaaaatacaaaaaattagctgagtgtggtgacgggcacctgtaatcccagcttcttgggaggctgaggcaggagaatcgctttaatctgggaggtggaggttgtagtgagctgagattgcaccattgcactccagcctgcacaagagcgagactctgtctcagaaaaaaaaaaaaaaaaaagttagctagctgaagagtataggaaagaatgggtacaggaaattacaggtgccaagttacagaggtgagagaaattatggtatctataggtaattgaaagtaattcagtatagtgaacattgaatagggctgggcggatgaaggcaaagcagaaaaaggaaagcagatgggccatggtaaggagtttatatctcctcccaagagcaatcgaagtgactgagagttttaaacacagcagtgaagtgaattacattaaaaaaataagaacttgggctctagaataaaaaacggatataggaggaaggcaggagtcacagtaggaatatcttttgggaggctgtgacaataatccaagtgagaagtaatggcaacttgagtcggttaattgtgttgagaatggagagaagttgacaggttcaaaattcatttttcttctttttttgagtctcactctgtcacccaggctggagtgcagtgatgcgatcttggcttaccgcagcttccacctcctgggttcaagtgattatcctgcctcagcctcctgagtaactgggattacaggtgcctgccaccacgcccagctaatttttgtgtgtttagtggagatgtggtttcgccatgttggccaggctggtctcgaactcctggtctcaagtcttccgcccacctcagcctcccaaagtgctagaattataggcatgagctaccacacctgacctcaaaatacatttaatagagcaagcatgagccactatgcccagcctcaaaatacatttaataaaccaatggaatttgaggtaatgatgaaagacacatgtcaaggatcattcctgtgttgttggcataagcaacagggatgaaaagcattgaggaagagcaagattttgggatgcgttgtcacacagttgattttaggtatgttaagggagggagacctgtaagacagcaaagtggaggtggtgcaagaattagttgtgttggctgtagcacagaggacagtttgagttaagagagttgggactgagaatcccgaggaactcttagtgttgaacatttgcgtggaggaggggacaccaaaggagttgccatagacatcgaggaaattaggaggtgtggtgtgcagaaagccaagtgaagaacatgttttaagtaggaggatgctatcaactgttttaaattctgctgagagtttgagaaactgaggacttagaattcatcattagatttggcaatgcgccaatcatttgtaatcttttaaacaatagttttgctgtactgggtagcaaaagagtgatttgaggagtggtcatttggagcatatgctattcaaacagagaagagtccacgggctttggtaacatgaaggtcctataaccatagcaagagaatgaggtgggtggaagtcatattaacgtgaatagaggagtaggttagatctgaggaatgtgggaacagagacagggtctcattatgttgcccagcctggctcagactcgtggcctcaagcgatcctcctgcctcagcctcctgaatacctcgggtttcaggcctctgcatctggcttgaaaacaacattttctcagaagcttgttttagttgttttagaaataacgaaggcatgtgtaaacaactgttctagaagcttagtttggaaagggaacgtttattgatgcatataacacttatatgttgggtgcttatgtgtcaggcactgttagagttgctcgggaaaatttacaaaccaagcaaaccatgccccttcatttcctttgggtgaagtgagggagccatgtggttatctgaaggaagagcttagcaggattagagggaagaaagtgcaaagcctcctagggtgattggctggctcttttggaggaacagtacctataactgaatgaaatgagtgagggtaagagtggcaggaaatgaggctagaaaaggagcttgggccatatcacgtagggcctcgtaggctgtgaatctgacttcatttcttattaatgaaaataaatacgatgatgggtgatgggaaacccatagaggatttggagcagaagaatgatataattaaaattttattttagaaatatttttctggttgtcgtaagaggaaaaatatttagccccagggcattttggcagagagttaggaggctattgtaacagcccaagcaatagacaataattgtttggattaggcgggtagcaatagaggtgatgagaagtcgtagcttctgtaggtatttggaagatatatattgtgaaggatttgctgatgaattccctgtaaggggtgagatgtaaagattcatagaacattaagatattttggtcagatcatctgatcaatggaaaggtcagttatagtggacagattatgagaagaacaggtttgggtgagaaaactttagatttcagtgttggatatcctaagttttagatgattattgatatccaagagatatcaatatttgggatcaatttgggaaatatgatcccaaagttcaaggttgaggttggagatgtaattcagatccgatggtagttaaagcagtgagactgaatgagataaaatagggagtgaatgaaataaagagtaggtgtgatattgacctcaagggcacaccagcatttagaggttgggaagatgaggagagagcagcaaagaggactgggagggccactaatgaaggagggaagtacaggaggtgtttagttctgaagccacctgaagaaaatgtttggaataggaagaagttgtcagttgctttaaatcattcggggaggttgagtgagatgagagtctagaactaacagttaggtttgatggtgtggaggccatcagtaaccttttctttcttttttttttttgagacagagtcttgctcagtcacccaggctggagtgcagtggcgcgatctctgctcactgcaagctccgcctcccaggttcacactattctcctgcctcagcctccggagtagctgggactacgggtgcccgccaccatgcccggctaatttttttttttttttgtatttttagtagagacggggtttcaccatgttagccaggttggtctcgatctcctgacctcgtgatccacccgcctcggcctcccaaagtgctgggattacaggtgtgagccaccgcgcccggcccaagagtaaccttttcaaaagcagctttgctctactgatttgggtaaaagcttagttgcagttggtttgggaggaaatgggagcagaaaatttgagagagtgagtgtagacaactctttcaaggaatttcgctataaatgggagtagagatctgaagactgaataattagcaaactgaaaagtgggaagacgtaattctcttattatttcatttttcttagtgaaataagaggtgaagttctctgagtaataggagggtcaaacaggtgttagaagttcacaaagaaaggaagaggtttgaaatagtcattttgagagtgggaaatgtagaagaattaacagtcattgctgagggtgcgtttgaaatctgtcatgagtttaaaataacttgtgtcatcatcgatgtgtttattttcaactatattcaactgcttgggtgtaggcatcaggtaggtaaaaaaagtgggttttattatgagtagaggttttgccacgtaattaccatggagggagggaagagcaaaggagttgagagtatagatacaaaggaatgattactgtaatgtgggtaagagaggaatggaaggctcagtgggcagtgggagtagggatgttgataggtaaggaaaaggtgataggatcaatgcatttggttctgcaagtgtcaaagtattgttggggaaagcatgctggaaggaaagatagggatgctggtgttctcagggtggaaggcttacagttgtagtctggaagtggtgattttattggcaattataaggtcaacggtatgactatggaattgagtggctaaggtctgttgaagaaaagattgtcggaaatgcaggggtcaaggaactggcctgtggatgttgaagtcactggcagtgatcaaggaatagtagtggagtgaaagtagttaatgaatcaggcactaagatctccaagggatgaaaggatgcagtttggagatgacaagataactgtagtaatcaggaatagcaggttttgtagctctgtctcataggcctcagaggagatgggcttttgaaggacaagagaaatgatgatgaataaattctaagcaggggaagtgtttgggaaagcagggcaggctttgtgctgttgatggcaaatgatgtaccagacaggatgaagttgagaatttggaagttgatcactgattagaaaggcttacattttattttggccgggggtggcagctcatgcctgtaatcccagcactttgggaggccaaggtgggcggatcccttaggccagaagttggagaccagcctggccaccattgcgaaacactgtctctactagaaatacaaaaaaaaaaaaaattagctggtcgtggtggcacatgcctgtagtcccagctactccgggggctagggaatgagaatagcttgaagccgggaggtggaggttgcagtgagccgagattgcgccactgcattccagcctgggtgacagagtgagactctgtctcaaaaaaaaaaaaaaggaagggcttacattttattttggtgctgactgggaatgaaggcaatgagggatgactgttggagaaggctgtgcttactaaacagtattattaagtagcagcatacatggtgttatactgacttctgattttgcaatagtacagacaggttcagattctcatttccaccttctccttctgcctaggtgaataactgctgggttatagtacagatgactgcagatcatttggaatttactttaaatgtaaacagtaaaaatttgaaagagagggaaagtgattgaggcaatttggggattgaataagaaggtctttttgttggaattcatttaaggaaagaaaatgaaaatttgatccctaatattatttaatgaagtggctaaatgaatatctctgctttgtggtttgaaaattaatattgattttttttccccctagaggaagaaatcctacttagcgacatgaacaaacagttgacttcaatctctgaggaagtgatggatctggctaagcatcttcctcatgctttcagtaaattggaaaacccacggaggttaaatattaccttttttttttttaacttaaatcaattctgtttatttttttatcacattttcctatatgtgaagaatactattcattaaggctgactcatagaaatttgcttgaatacacacacacagactgatgcataaatttgagaaatatctttccagttgttgaatagtgaatccaaaggtttaagccttttctgtctgctttgtaggatgttttatgaaacaaaggaatagaaattgtattcatattatacattttgaaattatatctatattatattttttgtcaaagcaaaataaattatacattaaggaaaatatttaagattcaaagttgtcattttctttctgttaatgagtatctttgatttaataacatttatagtttggtcacttgaaatctatagtgaccaaaagcaatgtcatatttagtagcctcatttctgttactatctgattattacttaagaattctacttaattaatagattattagaacaaaaggcattccaattttagagattcttttatggttaaagcactaggtaacttaaaaaatttggatcaaatgttatacagattaatagaccttggaatacaggggctatgtctttttggaatcagaccttgtcctggccttaattgcaggatgacttccttattaaatctctaaaagcaggaatgctctggaacaatgaacaattagaatgtggtaatgtaattttgggccaaaaaatactttgtagaaatgtgattctcttacttggaatagaaagaattctgactcgaaaaagtgcagttaatgtatgcttttctgggtaagatttgtgatagattttgattgagatttaaaaccatgatatataaatttagcttttttgtcaaagtaatttgccaccctagaatttgtgttggtaatttttaatgcaacttggacaatttctgaaagatgtaactttcttttttttgagacgagtctcgctttgttgcccaggctggagtgcagtgacatgatctcaggtcactgcaagctccgcctcccgggttcacaccattatcctgcctcagcctcccgagtagctgggactaccggcgcccgccaccccacctggctaatttttttttttatttttagtagagacggggtttcaccgtgttagccaggatcgtctcgatctccggacctcgtgatctgcccgcctcagcctcccaaagtgctgggattacaggcgttagccaccgcgcccagcctgaaagatgaactttaaaatggggaaggatactagtaaagccatttcttactcatgtatacatttttccctccatgaaattagagcagccaccttttacatgacttttacatgcatttcagatttttgtactagcaattaaaatatctactggatgtaaatcacatgtgcttaatgctttgcttcataatatctgttgaagtcaattaaaatatagagacagatctttaaattgaacatgttttatttgggaagcaagaattaaatttgaggcatatacacagactgggtgtccttggtatctctgaagaacaaagagaagtttggaggttatagaaaaaggaaaatgtgacattgtttttccagaaagttctttggcactagtaaattttggggagttggaagctctgatgggttagtgactgtggtgggtaaaactagtcttagagtcacaacaggttgtttcagtatctattagataaaacaggttttaggttacaataggcagtttcagcagctaggcttgcagaaaattacattcttagagtaatgttatgtgccttgagtgcttttttccccttggcccttgactctgatttagttgggtatgacaagaattatcaatttatataattactttttacatattgaagctgaataggttttcttaaaacttggaaatgggaaatactgggtcttgtgaagttttagtgtgaaaacgataactagtctcttatttcatgctctttgtaacaagtctacagtaatacctaatgtatctagatgacacctcagaaccaggagggaacaaaaaagacctctgagcagtcaaaataatgctataagcatgtattccagcttactttcggcatttctgtggagtgcaggaggccacattttgttcatagatccagtttgacaagcttgggtactgagttaaagtgaaaatggtgtaaataagtaatcatattcacatgacagtaggtggaagtgacagctgacaatctgaaagagtggacaaaactataaaaattagaactaagaactcttaaaatagaacggtttgaagtttgttacagaagggagcagctttatgcttcagtggactctgaaggtattggcagtgtatagtactgcttagtcattgatttaaattcggtatatatctcttctattgctgtcatgtacttgacattctgctgggtgctaaggctgtctgcaggctactaatatgcataataacaatcctgaaaaagaaggaaaagtatactgtgccttactgaagaaggcaggacagcctttggtatttgttagagtaaatattagttatcttacataaagcatgttatattccctgatgtcagggcctgataaatgagcccttacactcttgatagtcaatctgtgccactgttgctgtgtttgtatgttacaccatttcctgtccatgtaacagttaaactgtatcacatatctgttcctactaaactatttgcatataattttaacatttgagtggctgtatataaagctaaaagttctttataagatttatagcatcttagaatgtttaaattagataacattagtgtgcttttagtttttgaatttaattttgctcttgattttgtttgtgttaatgtagactttgtctacgtaagcttgagcccaactttggagtggtgttttcagtgatggaagtaactggaaataactcatgaaaccacttagtacttttgatagtttattcccatgaaggatcaaatttttacttgagtcattaatataaaaatttaaaagacatgtcagattttattaagcatggattttaaatatataaatattagaagacctaaacaaaatcgctaatgaaagagtaaaacatgtccctgcctatcatactcccttcactttcactgatttctgcttttatgaagtactttaataagctctacaacaaataaacaagacattgtgcctcattttacactctagcagtggttttccattccaactaactagattgggtttataatatagtcatttaaacttacttagttaaaatgttatacattagcaactgcaattaaggagctaagaaattcagctcgtatttatttatatgcatcttatccatagtttctcacttgttatatttgcctactgatggcaaattgattttttctgttccaaaaatgtagtgttttgagatttttggagatgcaaaacagcatcattttcaaattagatcacaaacaatcttacttgttgcagttgagactagtaattgatcagtgaggtgaaaaaattaggcaaaacggtatcatcaaaattttctttctttttttttttgaaacagagtattgctcttgtcgcccaggctggagtgcaatggcacgatctcagctcagctcactggggcccctacctacgggattcaagggattctcctgcctcagcctcctgagtagctgagattacaggcgcatgccaccaagcccagctaatttttgtatttttagtagagacagggttttgccatgttggccaggctggtctggaacttcagacctcaagtgattcacctgcctcagcctcccaaagtgctgggattacaggcatgaaccaccgtgcccgccccaaattttcttttaacttaaagtgttaatgtttgtttgttcccaatatttttatatatgtcaaggctttttcattatatacaggccagctctttggagttctgcatagtgtttcttgtttaaaccacacctataatgtaccatctacaatttccaattctttaagacagagtgaaaaattaagacacctgaagcaatctgagtgcggagtcctaggcattatgattttccttgacacttttagggttcttttatcacagtttatcaaacaccttttttttttttaacaaaaaacaaatttacaaaatctttccatgtattcaacttagaatttaatgaaatagggtttttttttttttggtggtcatgtatcatcaactttctttacatttaattaaattaatcaacaaaaaacatatagttgacataaacaaatttgggaccaagcactactgactcttagtaaacatacaagtcaactgttggtgcagaagtgccttgatgctagagagtagcctgcaagctgtaattatatatgggcattagggaatgaagaacagccttaatactattgatcttttaagtgaaggtcagcttagaaagcttttacttgttaaaaagcttcacagtttgtccttgtagttaatgcaattgaagttgaattaatctttcttaattttttttttagggtttctatcttactaaaggatatttcagaaaatctatattcactgaggaggatgataattgggtctactaacattgagactgaactgaggcccagcaataatttaaacttattatcctttgaagattcaactactgggggagtacaacagaaacaaattagagaacatgaagttttaattcacgttgaagatgaaacatgggacccaacacttgatcatttagctaaacatgatggagaagatgtacttggaaataaagtggaacgaaaagaagatggatttgaagatggagtagaagacaacaaattgaaagagaatatggaaagagcttgtttgatgtcgttagatattacagaacatgaactccaaattttggaacagcagtctcaggaagaatatcttagtgatattgcttataaatctactgaggtactaaataaagaggaagcacatttttagttattagtaggttctggcagactttattcccgtaaagagacagatagtaaatattttaggctttgtgggacatacagtctctgttgcagtaactcagttctgttattgtagtgtgaaagcagccacagacaaatgtaaacaaatgtgcctgtctttcaataaaactttatctacaaatacagatagtgggccacatttggcttgcgagctgtagtttgctgttcctgacttagtatgatatgcagcattgtgtagtggaaagattttatagtatcaacagacatttgtaggagtttgctattttataatttcgtatgcttttttcataatagatgtctctgctttttgtggattctcttcatatctactagtgtttactcttctgactttgatttttgggggtgtattttatttctttatacagaatttttttcttttttctttctttttttgagacaaggttttgctgtgtcaccccagctggagtgcagtggtgggatcttggccccctgcggtcttcaactcctgggcttaagcgatcctgtcacctcagcctccctagtagctgggaccacaggcctgcaccactacactcagctaatttttgtattttttgtagagatggggtttcgctctgttgcccagactggtctccaactcctggactcaagtgatccacctgccttggcctcccaaagtgttggaattataggtgtgagtcactgtgcctggcccagaatttctttacttgctcatgtgagagagtttctaataaactcctgatgcttttgcttgacactatagttttactgtcatctcagagtcagattttttccttaatttcttcattaaattgatttcttaatttctcatttgttttgcattagtttacaaaattacttaagatgcctatattctctgaaattttatattttatttcacgataaataagtttaaaaaattagatttgaccatttaattagagttatttccccatcatttttctaatggcaacaataattttagcatttgagcaattctctgtattttggtaactattagtaatcacttttatcagtataaacatgcatttcattttaaaatggttttcaaaatattctcataccaaccattcataaaagatgttccccttctgggaaatatcagtttttgctaacatctgcatttccctttgattttctaggaatttcttattaggtatacactttaagtgatatgtttcatataatattataggattatcaggatttcatgattttttttttttgagatggaatctatctctgtcgcccaagctggagtgccgtggcgcagtcttggctcactacaacctctgcctccccggttcaagtgattctcctacctcagcctcccgagtcactgggattacaggtgcccgccaccacacccggctaatttttgtatttttagtagagaaagtgctgggattacaggtgtgagccactgcacctggccttggatttcgtgatttgactgacatcttttacaccaattattgccatttttttattgggtactaattattagtattgctttctttattcgttaaataagaagtaaaagaacttttaaaaaataaaataactttttttcctagtacaaagcttattttcaattttttttattgcttaaattttgcaggttaattaaggctgtacttctttttcctacttcctgtttaaatatttggcattttttgagggttttctttctatggatttttgtgggggatcccatctcgttggacacttggttcctggagattgccaaattattgaaaagtttcctcatacccaaacattggcaatagactgaataaataacatctctgacattatttttcaattatatagagaatgctttttgtaaaatactgatttatttaaagatattacaatcatagtagttttttgcaatcttttttaaatcagtggatgtcaaggaacaactattgttctttgtacggcatttttcaacattgtgaagagttcttatactcaaaaagtttgggagacacagtgtgacattgtttaacctgagttgaacttgtcattttgtattcttgtttagagcagggattttattttgtctctttatctaactttgtattcctaactatttctttctttctctttggttctttgtttctttgttccattcttctctctctcccttttttatctatcatataaatatgtaaatatatattatatatccattagggaagaggaagttgtctaaagatatctagtatataggagctttgttctgcagaaaagaggatatgaagtcaattatattggaaattaatgcttaatactttttttaaagcatttatctcccaatgataatgaaaacgatacgtcctatgtaattgagagtgatgaagatttagaaatggagatgcttaaggtatgtttacaattataaaaatattacttcaagttctttccaaaggacatttaattaagtaaaatattaactaattctaaactaggttctaccacaatgaaattgctactaattatgtaacattagatttcacattttccaattcatgtttctttcatgtagtctataaataatgggttagaggtaatttactaattttaaatgtgctttccttgttccttcttattttttattttgaagacagggtctcactctatcacccaggctggagtgcagttgctccatctcggctcactgcaaccttcacctcctgggctcaagtgatcctcctgcataagcctcccgagtagctgggattatgggcgtgcaccaccatgcccggctaatttttatagttttagtagagacagggtctcaccatgttgtccttgctggtctcgaactctttacctcaagtaatccacccgccttggcctcccaaagtgctgggattacaggtgtgagccaccacacctggccttggatttcatgatttgactgacatcttttacacaaattattgccatttttttattgggtaccaattattagtattgttttctttattcgttaaataagaagtaaaataacttttttttaaaaaaagaacttttttcctagtaaaaagcttattttcaatttttttattgcttaaattttgcaggttaattaaggctgtgcttccttttcctactttctgtttaaatgtttggcattttttgagggttttctttctatggatttttgtgggggatcccatcttgttggacacttggttcctggagattgccaaattattgaaaagtttcctcatacccaaacattggcagtagactgaataaataacatctctgacactatttttcaattatatagagaatgctatttgtaaaatactgatttatttaaagatattacagtcagtagttttttgcaatctttttaaaatcagtggatgtcaaaaacagctattgttctttgtacagcatttttcaacattgtgaagagttcttatactcaaaaagtttgggagacacagtttgatattgtttaacctgagttgaacttgtcattttgtattcttgtttagagcagggattttattttgtctctttatctaactttgtattcctaactttctttctttctctttggttctttgtttctttgttcattcttctctctctcccttttttatctatcatataaatatgtaaatatatattatatatccattagggaagaggaagctgtctaaagatatctagtatataggagctttgttctgcagaaaagaggatatgaagtcaattatattggaaattaatgcttaatacttttttttaaagcatttatctcccaatgataatgaaaacgatacgtcctatgtaattgagagtgatgaagatttagaaatggagatgcttaaggtatgtttacaattataaaaacattacttcaagttctttccaaaggacatttaattaagtaaaatattaactaattctaaaccaggttccaccacaatgaaattgctactaattatgtaacattagatttcacattttccaattcatgtttcttttatgtagtctatgaataatgggttagaggtaatatactaattttaattgtgctttctttgttccttcttttttttttttttattttgagacagggtctcactctgtcacccaggctggggtgtagtggtgccatcttggctcactgcaaccttcacctccagggctgaagtgattctcctgcatgagcctcctgagtagctgggattacaggcgtgtgccaccatacccggcttatttttgtattttttgtagagatggggtttcaccatgttgcccaggatggtcttaaactcctgggctcaagtgatctactggcctcagcctcccagcgtgctggggattgcaggtgtgagccgccgcatccagccctgtgttccttcttgtgttactttcttgtaattttttcctggaatatgggtagtgatttggctctccagtattgaaattgagtttcctttcttccaattcatgtgtatccatttttatttggaagttttgtttttatacattcaataatcatctttactttctttggtattatttactatggatattttatattatataattttcaaatggattaaatggttcagttttactcttattattgagattgaaaatactagtttataatttatatattttctattcctttacctctaatttctttgtcaggtgttactaaccaaagatgtataataagaaaagccaatgtagctaaattaagtaaaaaatgaagaaaaacacagaagttccccattatgcatttttttattcctaatctttaggttgatgagatttttttatttttatgaaatgagattaatttattgacttttttagttttgaggccaagtaatgagtagtgagtaagaatgtatattctagggccaggcatggtggctcactcatgtaatctcagcactttgggaggccgaggcaggaggatcacttcattccaggagtttgagaccaacctgggcaacatggcaaaaccctctctctccagaaaaatacaagaattggctgggtgtggtggcatgtgcctttagtcccagctacttgggaggctgaggtgggaggatcacctggggagcctggggaggttgaggctgcagttagccatgaccatgccactgcactctagcctgggtgacagagtgagaccctgtctcaattaaaaaattaaaaaaaaaaaagtagattgtgaattcagatgtaggtttgtatcccagcttttccagttagtatctgtgtgactttggggaagtttcttagcatctttgatactcggttaacagttgtaattattatttaaggtattgcttgagaagagcttagtatagagcctgacatttagtaagtgtttaatacatattagctaacagtaaaactagaacataaatactgaattgtattttgttattaattatccatttctctgagaagtactgttccaatagtacatttataggaaacttgtggacgtctacaaacgtatacattaaatctcttagaaggcaacctggatgcccatattagagaactctattttaaacatgcattctaagtatgtttgtggacttgaataaaataaaacaaacagaaacacttctttcttctgccttcaggcttgaaatgaacatacttttttttaaaaaaaaaccttcaaaatgaaaatattaaataaaagatttaataaaaagagaaagtaaaaactgtagtttaataaagtcttcctgtctcttcatagttaaaaaatgttatagatgaaacaattttgaaatattcttgaaatagataatctttatttaggggagaatgtcagatactgtcaagccaaaataaaaacaaataactttatttcatgtttgtaaaattccttttctaaaatgatttgaatcttttgttgttttgacaattccaaaacacatttattgtttgctcatagtttcagccttattcagaaagaatgcgactgacacatgatatagagaaacttgttccaaaaataacattaaaatccacgtttactacttgagaatcgaaaatattgaggtgcaataaagaataaaatgttttaaattatccaaatttaaaatttatgatagctttccccaggggcagtttattatatgctattaatgagccttgtttatgctggaaatgttccatctttggccttgcgccttagaaaccattcatgagcacatatttaaaccggagcacacatgttcttttgtagtatggcttgcacatctgccagctttcgacaaaattgtaggccctgttaataatagtccttttgtgtttggtgaaaaagatacgacactgtcagtggttttgcttttaagatttcttttaaactttcagtctttagaaaacctcaatagtggcacggtagaaccaactcattctaaatgcttaaaaatggaaagaaatctgggtcttcctactaaagaagaagaagaagatgatgaaaatgaagctaatgaaggggaagaagatgatgataagggtaagcactgaagtatgtttgaaatgactcacctgtgatacctaccactgactttaacttaggatccagttttggatggtttggaggtcagggactttgtggcatatagttaattattggatccttataagcttttgtctccttagtgcttttgtctccataaagcacaatcttactacttagaaaaatagagtaatagcattatgatgataaaaatatctttccctttgtttttttgtatttctccaaatcattatagctctcatttagaattattaaagctgagaactctaacaatgaacttttattgtttagtggttaattatcttgattctttgttttgccctttcttggccactcaggaatctttcaagctcactgtggacagggaaagtgacttgggtagagctaacataacttcattgtgctgtgcagttagaattttgaccaaagatgtgggtaactaacttttcctaactaaatgacatttaggtaactaaactaaacgagattttcgtaactaaattttggtgtaactacatttagctttaggtaactaaaacgaagattttattttatctgtggatttttttagtgcgggactaatgtaatttctgattaccattaattgaaggttggttatattataacatttggattggtatattgcttgccatggtttgttctaaatgttagcctttagaagtattcctgattctaaaacatcagttttttttaatagtcctggcaaagtgtgaatcacaacaaaattctaatacttaaaagtaatccaagtgtcacagatggtacccagaagaccagtttgtattggaattaaaaaatagaaaacattaacccatggtagctgtcactgtattctttcaaagaagccaatgaaataaactgttttctccctctatgtggtgtttttctacttgaacataaatgcacattttattttatttccagactttttgtggccagcacccaatgaagagcaagttacttgcctcaagatgtactttggccattccagttttaaaccgtgagtataatctcatttaatcaaatcacatatttagtattctctttaaaacaagggaaaaggcaaataacctgtctgcttaacagcaacagcacaacttcactatagttatacatgccacactgtattttctgtgtgactacaaaattatttcaaagtgatatttatataaaattcatttctgcaaattgtttttataagtgaggaaaaatggttttcctttaactgagcagttctgagtagaaactagtttaaagatacttataaataaatgttaatttaatactgacttgtttttcattaaacgagtgtctatgtgcctgttttgtgtatattacccagaacatgcagatgtactagaagttcttaatacaacaatttgaggaatagtgataatcttatctattttaatgtactcaaaatttgtttacatctaacaggcacatttttgtgaggattaaatgagatgaataagaatgagatgaacaagtaaatgtgaataaaactaataagcctgtgaaaatctagactggatttttcctattctgagaatttaaaatataatccactgaagtatttctttccttttttcttttgatcttaaacattttttatttatgtcttacatacagaaaagtgcacatgttgtagagatcaatgaattgtcataaactgggcaccctgtggccagcacttagttaagaataggtcagtaacagcatgccagaagaccacctctccaattgatttttcccatgatattttattaagaaaattttctaagatgtagtaaagttgaaagaacttttttctgtgcatgtctgtattcccaccacctaaattcaactatcattactatacttgctttatcacatatccatccattcatatgtctctatccatccattcattcattccagttttaaaatgcatctcagggtcaatcgaggacaccattacacttccacctaagtatttcagcatgtaaattattaacgagttaaatatttacttaacagttttttctttggtgtaaaatttgcacgtaaggaaatataaaactttaagtgtacatttgcaaattttaaatatacatgtgcatacccatgtaacccaaattcttatcaagagatattattatcatcaccacacagagttcccttatttcccttttcagtcagtccttgtccctgagcatttctcttattattttaaagtattgattcttttggatatctagtatgaagcttagaatctgttttttactttagatgtatgtagtgaaatttaatatatataccaaatggtagttgttagttagcttgaatgggacattggtcaaatggcattgtttgttttaaagttccaggtttgtgcatttatgtatgaagtttgaaaataaattctatgagaggaaatgaaaaattgaatggattttaatttgtaccttgggtttcttattaataaaacaaaatagctttttgcttttcaccttcaagagttcagtggaaagtgattcattcagtattagaagaaagaagagataatgttgctgtcatggcaactggtaagttgtacttaagcaaaacctaatcctttaaaaaaataaaacataaagagtttgaaatgcttaatctttcattaaactctcaaaatacaaatgcaactacaaatgatgtaaactatagaagagagtgaacaaagaacagatgctcagatttatgtatcaattagcttttaggaagatagcatactagtattgaccattcatctgtataagtacattgtaaaaagaaatgaaagcatcaaaggtttatttttatttctatatttttttcattttatttttatatttttttcatttcaaggatatggaaagagtttgtgcttccagtatccacctgtttatgtaggcaagattggccttgttatctctccccttatttctctgatggaagaccaagtgctacagcttaagtaagtcatgttatcattgccacaatatcaccctctttttttcttctgtgggtgaaacatctgatccatcatgcatgttaaaatctagttcacaataacacatttctgcaggtattgctttatctttattggtaataaatgaccctttagtggaagagcttaccttctttcttgtgttctctgtaattcaaagctaccaggtggccctgataaaatttttttaaaaaacattattactttatgctggtttacattgaatatctcaaaattcttttctctttttgttacccttgctttttagcttgataagaagtgtatacatggaagtatattttttatctatgaaacacttttcagcttcttcaacctgagcttgcaatctgttttaaattgatacataatatctttacatattcatggggtactgtagtattttgatacactcatatcaaatacacttgatcaaatcagggcatttgttcatcaacttgaacatttatcatttctttgtgctgggaacatttctaatcttttctttgagttattttgaaatacacagtgttgttgttaactatagttaccctactgttggttaatgagtacaaacatacagttagaaggaataggttctagcaacctattcctttaccccctgtcatcccctgctgccctgagcttgcagtctctttcaaagacccaccttaaaaacttgcattctgataaggcccttgaaggaatttgcttatcaagttagtaagtgacaaaaaagaaaattgcaaagaacaggaatataaattattatatttctttattctttctcacttaagagtgaaattgatatgtgtaatgtgtacatggtgccagaatatttgtttttcttcttatagaatgtccaacatcccagcttgcttccttggatcagcacagtcagaaaatgttctaacagatattaaattgtgagtaatttttttccctcaacttttattttggatttatgggggtgcatatgcaagtttgttacgtgggtgaattacatgttgctgaggaagttgtgagtaatttatgtcatttctaatcatgtggtcagatgtctgtggtatatgagagaattttgtatacaaacaaattttactaaatgcatgaaaaaaaaagtccatgattttaaaatgcactttcttttgtacctttgcaggactgttactttttaaatccttcaaacttgaagaaatctgttattctcggttcttgggctataagattagcattgtactcatagaattataaaaattttggttttggaagagaagttggagaatataaagatttgtctcattttatagatgagaaaactgaggctcagagacaagtaatttgcccaaaatcacacaatgactggctgagcagggactggattctaggtctcttgcccaaccaattctatcatgatgtaattcctaaggagaatgtcatctcagatacacatacacacacccattttgtgtgtgtgtgtgtgtgtgtatatgtacacacacacacaaacatatgtacacttatatatacatacacacacatatattaatatatatgcatatatatgcatgttctaattcagaacattttcatcactcccaaaagaacacccctgcccattaagcagttgctttctttacgtatatattagtatatacatacacacgagatacacatatatttactgagttttgataaatgcatacaaagatgtaaaccaaacctctaacaagatacagaatatcactgacactctagaaagtttcttcatgtccctccccagtctgtccttccatcctccatcctaggcaagccactgctccgattttctctaccatagtttggtagaatgccatataaatgcagtcacacaatattaactcttttgtgtaagacttctttcatttgctgtaatgtttctgagattctttcatgctgttgcatgtatcagtagttttttgttttgttttgttttgtttttgttttttcagagtcagggtctccttctgtcacccaggctagagtacagtggcgcaatcatagcttactgcagcctctaactactgggctcaagctatcctcctgcctctcaagtaggctaggctgcaggtatgttccaccatgcctggctaattattaaattttttgtagagacaggatcttgcttggttgcccaggctggtcttgaactcctggcgtcaggattgtttccagttttggattattacaaataaagctgagacacatataagtctttgtatggacatatggtttcattttattgatacatgtcaaggagtgggatgactggatcgtgtggtggatatatgtttaactttcttttttctgagataaaattagaaggcgatcctcctgccttggctttccaaagtgccgggattacaggcgtgaaccaccgcacctgatgcagttgttgttgttgttgttgttttaatatctgattattattttattgtatttcattgaatatagcacagtttgtttttacattttcttattgatagacacctaggctatttttctggttttggactgttactaataaagctgctatacacatccttataaaaatcttttttgtgaacatgttttctttttttctaagcattttaaatcacctttattgaggtgtaattgacttacaataaattttatatgctgagaatgtataatttgataagttttgacacaggtatgcactcatgaaaccatcatcacaatccagataatgaacatattcatcacccacaaagtttacctttttgttttaaccccagtcaccgggtaactgctgagctccttcctgttactgtagactagtttgcattttctaaacttatatacatggagtcattcatattttatgtgctcttttttgtctgatttaaataatgcagtataattattttgagattcattcatgttattacagtgattaatagttcattcctcttattgttaagtggattacattttatggatatccaacaagttgtttatccattcacctgatagacatttggatcgtttccagttttgggttattacaaataaaactgctatgaacattcgtatgtaagtctttgtatggacatatgttttcattttattatatatgacggagcggaatgactggaacatgtgatgcatatatgtttaactttcttttttctaattgagataaaattcacagaacataacttttaccattttaatcattactaaagtccagtgggttttggtatagtaataatatataaccatcataattaattccagaacattttcctaactcccaaaagaaattccatacccattaaggagtcattccctattttcccttttcttttctttctttttttttttttttgagtcagggtctccctctgtctcccgggctggagtgcacttgcatgatcttggttcactgcatccttgatttcctgggctcaattgatcctcccacctcagtctcctgagtagctgggactgtaggcatatgttaccatacctggctaatttgttttattttgagtggagatgagattttgctatgttgcccaggttgctctcaaactcctgggctcaagtaattgtcccacctcagccttccaaaatgctgggattacaggcgtgagccactctgcccggcctattatctctgttctgcccacttccaaccactaatctactttctgtctctatgatttgcctattctggatgtttctataaattaacttatacattatatggccttttgtgtctggcatcttccacttagcatagtgatatcagtacttcattcggtctttttttatgactgaataatattccatagtatgggcatacacattttaaaaattcattcatcagtgatggacatttgggttgtttcctttttggctgttatgaataatgatgctgtgaacatttgtgtaccaatttttttatgaacatacattttcaacgcttttgcatatatgcctaagagtggaattgctgggctatatgctaattttttaagaaactatgaagcttttgagagtgattgtatcatgggatattcccaccagcagtgtatgagaggtccagttcctccccatccttgctatcacttagtctggctgatctttaacttaagccattctaatagtatctcattgtatttttagtttgcttttccctaatgactaattatattgagcatttttcatacacttattggccatctgtatatcttctttgagggagtatctgttcaaatcttttgcctattttttcttagtgagttttgatagtcatttctatattctgaatataaattatttatttgatatatgctttgcaaacattttctcctagtttatggcttttcatactttccacacagttcttttgaagagcagcagtttttcattttgataaagtccagtttgtcgattcgttcttttagggattttgcttttagtgttttgacccaaggtcacaaagatttgcttttatgttttctcctaaaagttttatagttttaagttttacatttagatttacgattcatttttagtaaatgttgtctattgtatgaggtattgattacagtttatgtatttttcacatattgttccagctccattttttaaaaagactatgcttttacactgaattgactttgtacctttgtcaaaaataaattgactacatatatgtgggtctattgctgcactctctattctgtgttctgtggatctatttgtctgtcttgattggtgtcttgattactgtagctttataataaacctggaaatcaggtagcgcaaggcctcttgctttgctcttttctttcaaagttgttctggctattctatgtcctttgtatttctgtgagcatgtcagcatcaccttttcaacccatatgcctgctgggattttgaatgagtttaccttgaatctagatatcgaaacaattagctgtcttgatagttattgtcaccgttttataccgaagaaactaggcatactaaagtaacttggctaacatcacttaccttgtaagaagtagaactgggctgtttgacatcagagcttattctttataccatttcctatgttaattagaatacaatattaatttcataaaggtaaaggcatatctgttttgttcctatttgattccttgtgaaagcacaatgcctagcgcacaatagacacttaaacttatctgttgaatggacaggtgaatgcttttaaagtctttccatatagaaaattaagtttcattacatttgacttgatctaggttttcatttcatagaatggagagcagactctgtaaatattttgccccagacctagccttattacaaacattgtcttaattaggattctgtctacccagaatagaaattaactcaagctagcatgagtgtatattgaaatttatattaaggataaaggaatgtctcatagatcccactcaaaagaaattagccagcccttaggaagagactggaattgggtttggaaaatacaataggtctttctttttatctgtagtctttagtgagtcttcctcatttttctctctgaagagataagcattctctgcatatatatagcattcttttagattttcgtgacataaagtattatttaaactttcataaggtatcttgattttaagttgtaattccttgagatgattgttttctttattgttaatatgtttcccttcctgtttttttttttttcttttttcttttgtttgtttttacagaggtaaataccggattgtatacgtaactccagaatactgttcaggtaacatgggcctgctccagcaacttgaggctgatattggtaagtgataaagaaagatctctgtaaatacttactgagttaatatttaaagttaaacctatggatggacactggatttcacttctgttaaagtttatttcaaacattacttcctccaggaaatctctgactctctaacttgctgtttcacctatcttatcccatgatactctataattccttttgctatagaaattaggctctgttatcataattacctgtttatatatctgttttcttctgctaggctataaacttttcaagggaaaaatatcactttttaaaatttatgtttccccagtgcagtgcttggcatataggcacttaaacatattgttgaatgaatgttgaatcctaggttctgtgaaattttaatttacttgtttttcatgttctgtatctaaattaagtcagtgtagtggttttgtaccctctttgttcataagaatcacttttcaaactttaaaaaaaatgtaggtaaccaacacccaactctgaaaattctgatttaacaggcctgggttggcacctggcattggtggtttctcacaggtgattctgatatatagcccgggttggaaaccacagtacctttgattagttgccactagtgagtatgatttattacaaaaaccaaaaacttagataagtcacagtttatttcctagaacgtgtaaatatagaattagtcaaaagctgatagcactttttttgtacttaaaaatattttaagcctcagtatagtgagacctcatctctacaaataattttttaaaaaattggccgagcctggtggtgcatgcccatagtccaagctacttgggaggctgaggtaggaggattgtttgagcctgggagatgaaggctgcggtgagccaagatcatgctactgcactccatcctgggcaacagagcgagaccatgcctcaaaaaaaatttttttttcttcttggtggttaggcttaactatccaagaattgcaatcatggcttctattgcaaatgcccctatttcccaccttcagttggcctaaccaaatttaatttttcaatatcatatgatctttttgtataattatgtattcaaataattccagataggttaggttttcgaattgcaacgtctcatttaatggttactttcatataactgtaggaaagcatttgataatttttccaacaatgtaatgaaaacaaacttgtatcttttttattatgtgttaaaaccaacaaaagaatgagggcagcaattaacatttcattaaatatattagcaatgagtacatttatgagctcttaaactcccttattgacatactgtattttttgcctttaatggacaatgaatttgatatgtttcctaataggttgtatgaagttattgtgaatatttcactttggattaagaataactaccctatatataaatttcatggttgtattgcaaaagctggggtctatgtccatagtggtttgggtacgtttttactatttgctttgtttctgtgatagtgttaaatgaataataagcttaagtatttaagcaaatacttaatacttctgacaagtagttagaactctctatttttgtttttttgtaatggatgagttatggacactgcaattattagagcagcgtactttgcttatgatggatgaaaatgttctctggttgactcagtgttgaataaaaagggatacatgaaataaaaattatttttgaaatattttcctttgccttttgttgcgggaaattgtacaatgcttgcaaaaatgaatatacgcaggatattatttgtacagcagtctgacatttagctaatcagattcctcatttttaggtaaatgttaaattacttaagtagtctggatttttaacagaaacagcaaacatagttttatagggaggctccttaccaaccagacttttaacttaagtgaatgttggcaaaagcttgtctaaactgatttccagggataaggtttagctccattaaaagctagtttgtcaaacctgtaactaaagctttttaaaaaatgaaagttttaaaagagaccatcattctgttttaacctatttaatttaaaatctgggctgaagtaggagtattgcttgaacccaggagttcgagaccagcctgggcaacacagtgagaccccatctctgaaaaaaaaaaatgagctgagcatggtacctgttacagtgctagttatgaaagaaagaaagagagagagagagaaggaaggaagggagaaaggaaggaaggggctgggagtggtggctcacacctgtaatcccagcactttgggaggccgaggcgggtggatcatgaggtcaggagatcgagaccatcctggcgaacatggtgaaaccctgtctctactaaaaatacaaaaagaaaaaattagccgggcatggtggtgggtgcctgtagtcccagctactggggagggtaaggcaggagaatggcatgaacccgggaggcagagcttgcagtgagccgagattgcgccactgcactttagcctaagaaaaggaaggaaggaaggaaggaaggaaggaaggaaaaatcagtcactcactcaggtttagtttcaaaagccaaaacagtgataatattgaattttttccagccactcagtagtacccagagaattttgatacaaataactgactttgaccccatgtttagtaggttttttttttgtttgtttgtttgttttttttttttgtctttcttctccacactctcttaggactgttgtagcttgtaatgttagtgaattgtaattgtttatttgcatgtctgtctcctcttttagaattgtgaactcctcaggtcatggattgtattttattagtctttttattcctagaaaagtgtttggataataatagatatttattaaccataataggagtagtagcatttttgtgtgtgtgtgccaggccctattttagcattttatgtgaatgatataatttaatttttagagcatctagaaaatgttaggtaccattattatccacattttacttgtgagaggactgagacttggaaagcttaagtaacttgcttaaggtaatacacatggcagatggtggagccaggttctgcatctgggcagtctgactttagagctttttaatcatcctcctcctagtgtccgaacattattaatgctcagagaagtatcaaagaatgatgatactcattgagggaaaaaattattcttaagtatcaatttgttaattgaggacaaaagcactactgttactactgtgaaaaatctgaaaacattgtcacggatgattttacaataacatccttttctgacatgcattacaacacactattgattccgtttcaatgtttgtgtctggtatgggggcggagtagagaggctactacaggaagaaagaacaaataacatttcttcttactactttgtgcatcatgtgatttagctcctcccataccattttacattagaaaatgtggctgtcctcctgtgctctagtactggcatttcagaggactctttgcaatatgatatgtgatcaatcatggatggcgatgcagttaatttcagtagaaatttgctgactctttttatctcttttaatagctaatgcatgagataaaattgaaggtattaccaaggagaaatgcaggtggatagttttggaggcaaagtcacagtaagcaattcatctctccaaggaatagtgatgaaagctgagatccaataaatgtcttgtttggattaatacataaatatttccttttaaaattcttaaggcttttattcatatatctcccctctccctatttccaataatgatttttggtgttaatatgatgatatttatgcttctgtttttataggaaccaaatactttgatttggttatttattctcctttggagatgtagatgagtttattttttcctttcgagctttatcttttcctttatgtgtttttcttttttacaggtatcacgctcattgctgtggatgaggctcactgtatttctgagtgggggcatgattttagggattcattcaggaagttgggctccctaaagacagcactgccaatggtaagctttgccaagtctgatgtcccgaaattacattcttaataaggagagcattcaggattggggagtggtaaagaagctgaagacttcactataaaagagcaaatggataatgtaaaaagagaactatttttttaaaaatgctaaagttggtatataatctattgaggaatataatagaacaaggcttgacaaaccttttctgaaaggaccagataataaatatttcaagctttataggccacatgtagtctgtatcacatattcctctctctgttttttcttttagtaaccctttaaaaatataaagagttacatttttcactggtgggccataacaaaacaggctgtgggccatatttgtccgaatgtcttctcagtgatctttcatccgtatgtccttttactctaggatgctgtgaaatcctggttaccccttcttgtatcacattgaaaacctaaagtttgaactattctatagaaattttattaaagcttttggtattagaatttccctttcttccctaattataaaaaatagcaaattttggccgggcatggtggctcacgcctgtagtcccagcactttgggaggccgaggtgggtggatcacctgaggtcaggagttcgagaccagcctggtcaacatggtgaaaccctgtctctactaaaaatacaacaattagctgggcgtggtggcaggtgcctgtaatcccagctacttgggaggctgaggcaggggaattgcttgaactcgggaggtggaggttgcagtgagccgagattgtgccattccactccagcctgggcaacaagagcgaaactctgtctcaaaaaaaaaaaaaaaaaaaaaaaaagtgaatttttacatgaatattctacatgattggcatatttacatgaatggtttaaaaacccacaataatagcactgttttattttttattttgaaaattgtagattcacaagaagttgtaaaaaaaaaaatacctatatagaggtcctatgtacctttcatccagtttcctgaacagtaacatcttgtgtgactatagtacaatatcaaaactaggaatatgacatttgtacagtatctagagtttattcctatttctctagttttgtaagtactcttttgtatggcatgtgtattgttctatacagtttaatctcatgtacatttgtgtaactaccactgcagtcaggatgccaaatgttcccttaccacaaagctccctggagctgttcttcccacccctggccctagccactggcaaccacaaatctggtctctatctctaaaatattatttcaagaatgttatatacatggaatcatgcaatttgtcaccttttggaattagtttttttcactcaacataactaccttgagatctatccaagttgtttgtggtcatgtgttgcctaacaacagggatatgttctgagaaatgtgttcttaggacattttgtggttgtctgaacatggacttacacaaacctacatgataaagcttactgcacacctaggctatatgatagagcctattgctcctaggctgtaaacctgtacagatgttactgtaatgaatattgcaggcaattgtaatacaatggtaagtatttgtgtatctaaacttatctaatgtagaaaaggcacagtaaaaatacagtataaaagataaaagatggtatacctgtatagggtgcttcctgtgaatggagcttgtaggactggaagttgctctgagtgagtgagggagtggcgagtgaatgtaaaggcctaggacattactgtacactactgtagactttatacatattgtacacttaggcgacactaaatttttaaaattttctttaaaaattttctttcttcaataataaattaatctcagtttactgtaactttaattcataaacctaaaacattttttgactttggactcttgtaataattcttagattaaaacatgaacacattgtacagctgtacaaaaattttttcttccttgattaatgcattccataaggctttattttaaaattttattatttttatttttaaaacttttttgttaaaaactaaaatacacacatatcagactagacctacacagggtcaggatcatcaatgttgctgtcttccacctccacgtcttatcccactggaagttctttaggggcagtaacactcatggagctgtcatctgtgataacaatgccttctcctagatacctcctgaaggacctgcctgaggctgtttttcagttaactttaaaaaatgaatacgtaggaggagtatactctaaaataatggaaaagggtataggtaaatacgtaaaccagtaacatacttgtttattattcatcaagttatatactgtatataattgtatgtgctatactttttaatgcctggtagtgcagtaggtttattgacagcagcatcaccacaaacgtgagcagtgccttgtgctaagacattatgctggctatgacatcacttggtgataggaatttttcagctccattataatcttatgggaccactgttccacatgtgctctgtcattgacagaaatgccgttaagtaccacatgactatttttcggtggtctgttcctttttattattacagagtattccacagtatggttgtaccacagtttaactgatcacctgttgaagaacttttgggttgttttccagtttttgactattatgaataaagatgctatgaacatttgttcatatctcaaaggttctttatttttttttatttatttttctttttttgagacagtctggttctgtcaccctggctggaatgcagtggcgcgatctcggctcgctgcaagctccgcctcctgggttcacgccattctcctgcctcagcctcccgagtagctgagactacaggcgcccgccactgtgcccggctaattttttgtatttttagtagaggcagcgtttcaccgtgttagccaggatggtctcgatctcctgacctcgtgatccacctgcctcggcctcccaaagtgctgggattacaggcgtgagccactgcgcccggccttcagagattctttaatgggtgaatggttaaacaacctgaaaatataaaagttttcatttctctgggataaatgtccaggagtgtatttttagtttttaaggaattgtcacaaacctgttttccaaagtggctgtagcattctacattcctgtcagcagtgtgtgaatgatctagttatccttgccaccgtttgttgttgcaactgttttttattttagccatttcgataggtgtcgagtggtatctcacttttaatttgcatttctctcatggctaatgatggtgaacgtcttttcatatactaatttgcctctggtgaaatttcttacataattggagtgcttgtttttttctgttgagttttaagagtttaaaaaatacattgtagatatgagtccttggtcagatacgtggtttcaaatatttctttcactttgtagcttgccttttcattctttttaccgtgtctttcacagagtaaatatttaacattttagtgaaatccagtttatcattttttcttttatggattgtgctcttcacctagccctagatcctgaagattttctcctgtggttctttcctaaaattgttacagttttatgttttaagtctgtgatccattttgagttaaattttgtataaggtgtgaggtttaagtcaaggttcattgttttcccaatagattaaattgcagcagatcctttgttgaataggctgtccttcccctgttaaattgcgtttgcccctttgttgaaagtcatgtgggtgtatttgtgtgggtctatttctgggttctctagcctgttatattaattttgaacgaataaagttggcttatgtttaagttttcttggtagtagcgaggcaatggtgccttctgagcccaggatttcacaattttgtgagtaaactgtgttagaaattgtttgttattcttttggtaggttgtctagttcaatttcattgctcattaatcttgcttatagatagcaaattgagaggcatctcaaaaatagtatcttttgttagcttatctcacagagtttggttggagcagatattaaaacagaacaaaccaaaaataaattaaatatactagttagcaagtttatattgagggaaaatcaaaccatgtgaattgagctccaatgatgtggctggccttgggtcagattttagtatcatggttcaacaaggtagctattaaaatcttcatactttttcttgaaataattctttagtagtcacataggacagcacacactcatggatttcttctttccttactgtctctttattctcagcctcctgttccttctcatctccctgaccttttaatgttggccttccagaaactttagtctttggacctacctttgcactcattttcttggtcatttcacccaacatacagttttatgttattttatttttttatttttgagatggagtttcactcttgttgcccaggctggagtgcaatggcgtgaactcacctcactgcaacctctgcctcccgggttcaagcgattcttctgctcagcctccccagtagttaggattataggtacgtgccaccatgcctagctaattttgtatttttagtagagatggggtttcaccatattggccaggctggtctcgaactcctgacctcaggtgatccacctgccttggcttgccaaagtgctgagattacagatgtgagccaccacgtccagcctacagttttaaatatcaagtctatactgaggactcccaaatttttatctccatcatagactgatatcagcagtatatgagtgattcagttgtttttgcctctttgccagcatttggtgttgtcactattagttcattttagccatttaatagaatatatgtacatatatatgtgtgtatacacaggcacacatctatataactactcaacatgcctctggtgagatgaccaacaggtatctcaaacttaacctcttcctaattgacttctgcatagcactccagatctgctctttcctcactctcctccatcttgtttaacagcagctccattggccaaaattttggaattttcctcaatcttttctctttttcttacactccactgtttatttaaacagtaaggaaatctcgtgaggtcttcagaatatatgcagaattaaatcacttctctcttgatccctgccattccccaggtacgggccaccatctccttagggcctcctgctttcactcttcccatccctcattctgtttcaacacagcgtccagagtgatactttaaaaatgaagtctgatagatcatgtcttcggctcagaaccatctagtagcatgccatttcattctaaataaaggcaaaagtccttatgatgagttaccgatcctcatgtaatctggccttccattttccctctgatctcattctctactggtctcctcattcaccggatgcagccacaccaccctccttgtttttcttcggacattccaggcatgcttcagtgcctgggctttgcgcctgctgcttcctctccctgaatacgtttcccccacattgtctataggatgttctcccatacttctctcagatctcttggatttaggcctcctgggccaccatatttgaaatatcagattagttccccctcccccatcattcagcattcctcgtaaatctttgctgttttaaaaatagcactatcactgtctaacttactgtgttatattttgttaattttctgtgagttcttcttcactagaatattctttgtagggaggagtttttgattgtttggtttataaaatctggaacaatacctggcttataggaggtgctcaatttataatggggtgaatgaatgaatgaatgatgatgagaaagctgagaatcagtaaagtgactttccaaaacaggtagtgggcagtatagagttgggccataaatagctgcaccatacaacatcctgctagtttctaaagcaaatgatttgaaagaggcataaaacataatttctgccctcaggtagctcatagttcagtaaaggagtttagattcatacctataacagtagaagtaatagcaccaaatgaaatatggtattatgaagtggtacaaataatataaaaagatgaacagtgttagtagtacatgtttagaagggatttctgtggtgaaagtcactaggcacagtgcacctggaggaccgatttccattccatttagaatggtttaaagtaagcttttggaaactaggaagattactttctgtaatcctttcctaggcctttgattctagaaggattgtgttaaaggagttttaaatattttatacagttcttaaacattgttaagcttgaattaaatcttttattatgtctggccatggacgtcattggatcattttcatttcttgggaggattaataaagcacattccttctgttgggcctccagtgcggggagggtgttggccgagcagtggctgagaaaacgtttttcccctggtgttttcaagaaccctctttattagctaagtggtgagacatgccacctggtggttatagtagtatcatttttctcactgttcttggtgcttttcttctccttctgattccagttatactaggacaactgctataaacctggaatgtttcacactatattatttcagtaatttcaaaaacagcagaaatcactaagctgtttggcacaaagattcctatttggaaggaatcagacaaagtgagtgttgagaaagaacagccaggcagaaagctttgcatcagtcttaaagttctttacatttcaagtaagaggaattgtgaaatccataagacatgtggggtttttctattactttctccccagtatctattacaaagatcagcacatagtaggtactcagtaactatttagaatgagtgcatgaatgaatgaagtatgtgtgatgttatggagtacaaagttagaattagcaacatgacctgaatttagaagcaggtgggatacttatacttttctcagtctgtgggcaccacaccattgaagtatatgtctaagattaatttatatttggttgtttgatttagcaaaacttgctgcctgttaaaaaagaaattaagacctgtcaacttaaagaatacattttgtgagttaagaactaaatgacagtataatttattacccaaagcagtttgcttctgaaaattaaagagttcaagctattaataattatgctgtgactgcaggcataaactgggaatgtcctggcaaatgaggatgtattgtcacctttctcagcctgcctgtgtgttgtttttaagcttcactctagtttatatattttaaatgtcataaaataccacatacttataagagaaaaggttctattcattgctgaagtggaagcttatcattaatttttatttatttatttttttttccagttttggaattcttattactttgaacccaagaaccactgataactagcacaatccagtgaaacagaggaagcagcagcttaatcaaaggaaaaatacatttaagattataagtctggttataagcttaaaaagtgacccagaaagggatatcattgctaaaaaaaaaaatccccttgtgacctgggtacattttgcaaagccacaggtttgcagtgttacacaagggccaaaggaggccatgagttgtctttggttgtggggccggagggtaactgttcatgaaaatagtgagtgtctgaagattaagaaaatcatgctgcagcagaggagaagggagaggaaggcaggaagggaaaggagatgcctgagggtcaaaagctgagcccaagcctaagcccaagctcaagttcaagccccagcatggcacaattttgtgaattaactcaggctgagttgcctccagtctttggaatgtcatcttatactggtactgctgaggcagagggcagtaattggttctttgggataggagaaggggcagttgctgaaatacaaaattaatagtcagcatcccaagttcctcaattgcagccaaaatacatgtgttcaggcctttcggcagtaccgcccccagaactaccagctgtagtgtggtctattcccagacagcaacatgcaagaataagtttacaatacactcagcccttgtggcttaagatcaggggctcagaggctgtgacaactcatgatgctgaaaatgtatccaatgaaaacgaagtactagctcgtttagtagtaacgaagtactattaatttttaatatagtctgatactttattttctaattgtagaagcaacattcttagctatatctttctagaatgttgaggcaaaagagtaaatttatagtgattttcactgttaccagattgctggaatagggaatttctggtagcaagatgggaatttttaagttggaagggtctaacacatcatatagccgtctccatctcattttttttgctgaaaaaactgagcccttgcaaatgtcagttgcaaatctgggagtagtactcatgtctctgaagttgttatatagaattctttttatttattttaataacaatatttatgatagttgaaactttttgagtgcttactatattttatttcatgcattatgttcagcactttacatgttttatctcacttgatattcacaactttatgagattggcactgttattgtagccattttatagatgaggaaactgaagcttagagagttaaataaagagctcaaaatctcacatctagtaagtggcaaaaacaggatttcagctcaagcaatctgattccaaaacagacttttttcactgtgctgccattcttttgcctggtttttctgttaacttcttaaatatatgtcatgtttcatgcttacttcctcattttcataaatatattacctgctcacttatacattatattgcttagaaacaaacccaaccctgttttcttatggactgtatcctgaaaatcactgtttttaatatgtggttaaacaagtgttttattagtgcatttatataaattatttaaccaaaacacttaaccggtgaaagtgctttactgtgagagtgagaatgtgcatgttctaagaacctctaatttttaaacctcccttattctcagccttatatttgttaaaacctgtgtgttaacacagatgcacccatgttaggggttaattagagaaaccaacctctttatagattagcttgttcatctttaagttgctaggcaggcactgtaaattcagagaacaatctgattgtaagccacaaatcaatgaaattaattttggggttgccttttaaaatagtgtcacaaaatttaaggataaagaatgcaaaaatgatgccaattatctcatcacattagttttgatttaatttttttaatttgaaaaaacctactcttaaacttaattgatttttttaaatataagtttggagataatttttaattcagtaaagttatagtgattgaaaaagtagtttataatttttaataaattgatcttgttttaattttgagtcatattctagaagtgcttctttgcaaattggtaaattgcacatacatttccacttatatacaagataattgctatggttggtttgtataatagatgcagtgcatctgaagagctattttatgagaatattgtttcttgtatctgtcacgagccaaaaagaatatttttaagaaagttatattcttggtgatagaacagctgataatttagaaacaactgtaagacagtccactttttctgattatgaaataataccatagttaagtgtaatttcctataatagaataaaaacacgagttctagttttaggggaggcatgttgttaccgtaccttagaatttctggaagatgacatattcatgcttttcctgataactgctgagtctcctgctctgtctgccaatccagtcaagaagcctttgctagcaatcaattaataatacgtttcatttatacatatttcctatatatagtatgttattgattatctcagtaccactgaagagaggttatctgggtcattggagctttgcttctagatttgtgaagccataaacctatatatttaaaataggaggccaaaaaaaaacgaccattgctttatatagttagattttcagtgaattgagagtttatcatttgtaattatacattaatcaaatataaggcataatatacccccctgcttatatcagcaccatttcaaatgtaatgttaaaaaataataaatggagaagtagatagctaacaagtaggcttaatttaataagacaaagtaaatggcatttggaaacctcatggatttaatgttttatttaaatgatttctgatttttaaaaagtaaatattgtatccagaaggctgagaaacaagttagtagggagattttttctttgcaaaaaaattttacagttgtgtctttaacattgtaccacaaactgttgtcctaccagtctctttgtaagaaagctatagacatgttgggaatgaatgagctctttcctttttaaaatatcagttttacatcattcaggttccaatcgttgcacttactgctactgcaagttcttcaatccgggaagacattgtacgttgcttaaatctgagaaatcctcagatcacctgtactggttttgatcgaccaaacctgtatttagaagttaggcgaaaaacagggaatatccttcaggatctgcagccatttcttgtcaaaacaaggtaaggatttaatggttgatgaattttggtaatgatttcctttttttttttttaacaacttatgtattttatgttatttacgatttccttctaatgcatatttaacatatttcaaattccacctagttttggttcaagtcaagcatgatgttatataatcaattcagtgattgagactagtgtatttttaaaagcagaaaccaattctcctaatattttaataccccattctgttgcttaaacagggcatatactatttatttttattttttaaaattttacttatttatttatagagacagggtctctctgtcgtccaggctggagtgcagtggtgtgatcacaactcactgcagcctcaaactcctgggttcaagcagtcctcctgcctcagtctcccaagtagctggaactacagtcttgcaccaccatgcctggctaggacatatacttttaatgattgataagtaaacaagcaaacataaaatgactctttcatctgaattctgtctagtttactaattacatgacttcagtcttaaggagcttagaaaaggtcaccttacaaacacagtggagcctgtattgtgttccaaggactattgtaggcgctttctatataaaatgatctaatttaatccctataactgctcagtaagttacgtattattttcattttattgttgaggaaactggcattagtacttttttctgtttattttgtttaaaggcattttaaatatatatgttaagaagttttcaaaagcctatattttactttttataagcctttattttactatttgagacagtgtcttgctctgtcacccaggctggagtgcagtggcgcaatcccggctcactacaacttccacctcctgggttcaagctattctcctgcctcagtctcccaagtagctgaaattacaggtgtgcgccaccatgccaggctaatttttgtattttttagtggagacggggtttcaccatggtggccaggctgatctcgaactcctgacctcaagtgatccacctgtgttggccttccaaagtgctggaattacaggtgttggccactgcgcctggccagtttataattttaaacattaaaataaatgcttcttgtccaatcatggtgtctcacacccataatcccagcactttgggaggcagacgttggagaatcacttgaggccaggagttcgagaccagcctgggcaacatggtgaatccctgtctctacaaaaaatacaaaaattagctgggcatggtggtgcatgcctgtagtcccagctatttgggaggctgaggtgggaggatcatttgagcccaggatgttggggctgcagtgagctgagatcacaccactgtactccaggctggatgacagagcaaggccccgtttcaaaaaaaaaaaaaaagcttctaccaatacaaacacaaaacaagcatagacaaatagagtttaaagaacatcattggtgttttcctctaaagggaatattgatgctaggccaagaaaatcctggagttattcttgaggaccttaaggaataattgaaatgtaggatttgctcctggctttcttgtcctatattcagaataaaacaagaatggatcgaatatattctgagtgttctggccattctagtgctctctgaagtgagtactcactgtgtttcacttccctttcatcctaaagaggaaaagttcttttgaagaaggctgtttgtcctaggttagagtctccacagtcagatcattatctcctcctaatctttgatcctgttcagtctctatggtactttcccttataataacactctctatggcactttcccttataataacactctcctttttaaagcagtttgccttttttgtgtgtaatattgttctcctggttttctgacgtcctggtcctcttataatcctatgcaaatgtttctttctgtttttcatgttgactctgctaattgaggtctttgttactttttagccgagactattataatttccccaacagatatccctctccccagtgccccttgttgctttctatgcagtttacaaattattgtctgcaaacacatccttaagtctggaatacctttctggaactccttactaggaaataaagaccagactcagtgtaacattcaacagtattgaagatctaggtatttaatatgaatttttttttttaaggagatcaagaaagatttttgtacccatttttaatcctccaagaagacttaggatagcaggaaaccattgagagtcagaatgctttctacagatcttaggtgaacagaaactttcctcttcatgagcagtgaggtagagggtaattaaggcttcagagcattgcccgttatttccatcttcttcccttcctttaattctgctaaattcctttaatttgtttatcagtattcaagtatttttatccattgagctaaggtgtttcttaaactaaccctattttgttaaagtcttaattataatatattcatagtacatttaagtgagatagatgagtctctcatataatttagtggttagattagattagaattttctcccctcagaaaattaagaggaaataaaagtctgtagcaaatcacttggcaaaataatggctccttttgtaataggaatttttactcttttgatttatctgttacataagttcaaatttttacatattttccaccttttttaaaaaagagtgatatgtagtcaatatcaatttgagcaacactgttgcatataaattgaaaaggactccaattttctaattccgtacctcagttgtgatcactgttggtattttggcatttatgtagacttcctttctctgaccctactactgtgcagatatatagttgcagttttttgttgttgttaagttgatacagaaatagttgcatactatatccattatttatgcaaattttttttcatttaaagtatctgctatctttccatatattgcattttcttaaattagagccttaatatataggatattacaatatctaggttttgttgagtagttttttcttctttgaaaacatgtttttaaaataagatttttttttttttttttttgacatggagtcttgctctgtcgcccaggctgtaatgcagtggcgggatcttggctcgttgcagcctctgcctcctgggttccagcgattctcctgcctcagcctcctgggtagctgggattacaggtgcatgccaccatgccctgctaatttttgtatttttagtagagacggggtttcaccttgttggccaggctggtctcgaacttctgagctcaggtaatccgcccgccttggcatcccaaagtgctgggattacaggcgtgagccactgtgctggccttaaaataagatttttatacactaaaagaaaacttacatttttcactccattaagtagttcactgtgaatttttgatattgaagcccatttggttgctgtcaaaaatagatttgaacagattattcagtatgactcttgtagtgaaattattgccttgtttcctctgcttaagttttcagtggcttttgccacagtccttaaaggttttataatttttttaatgtttaatttttaaatgtttgcttaatatttcttagtatgagtgtagataatgatgaacatttagatgactttttactattataatgttgcagtgaatatttgtttacatttatcttttggccaataagcaaatatttttgtaaattagaatcctaaaattgaaattggatcaaaagttatatgcacttgaaattgattaacttttcctaaatctaaaatagtatagtcttttttatattgtcagcataaatgaatgcacttatgtaaatgaatatttttaggcgttaagtaaaatattctgtggaaattgaacatttaagttgtttatacttctatggaaatcgtttacgcttttaataaagaagcacaagtttctacaaaatacattctaacagatgttttctataacattcagtctcaagattactagtaaatacttctttgaactgtaaaagcaatctttcaatattataagaaagctcttgctttagtaaacatttagaaactcagctttattatcataagcaagaataagaacagtgtaacaagttttatgcacactcctttgtaaaccctcaccagactaattgttaatctggtgccttgcattccccaaagtatttgtatctgtcgtttataagtttttatcaaggtttcagctaaaacaaataaatttgtttctggttttagctttaatttgaactgaaacagtcaaaactgagttttggggacttcacacaattcatttggatatttgattctccataatgttttaaattttcatgcacttaaatatatcattatttttgataggctttcttcctttagtcttttctttagaaggtagaaaggaagaattaaataagataaaaccaaacgggtctgaagcatgtataaagtatatatgtttgctcttttgttcttctttttctttagttcccactgggaatttgaaggtccaacaatcatctactgtccttctagaaaaatgacacaacaagttacaggtgaacttaggaaactgaatctatcctgtggaacataccatgcgggcatgagttttagcacaaggaaagacattcatcataggtttgtaagagatgaaattcaggtatgaggatcaatcatcattgctctccgttgctcatagtggaagtggatatttctcaaatgtttatttaccagatctttattgaatactttctttgtgttgaacataaagcagtccctctgataaatgtgggagaacaaacttgcagattagtataaatagcaatctgtacctagtgcttaggtgcacagaggagggaggaatagctctgtcaaggtagttgtgtaatgggggtggtccatccaggaaaattcaattagagtccaaacatgtaagtagaagtttttcaagtatgccaggccagtaggtgatgaggggaaaggaattggttatagaattccaggaagaaggactagcaggtgcaaagacactttgatatgagaacacatactgggttcaggaaatgtgactggtatggaatggttggagggaaagacaatgtggggtaggaatggcacaaagtatggacaaagaggcagggtggaaccgttagagacttgagagaacagttgaatgggtcggttggccaggttatagatggctttaaaacttgcaaagaagcagtctgggcttggtatcatatacctgttagttttcactgactactttagccttagaatttttagtttagatacaattttctgtaataggtaaaacggattaaagtagaataactctggctgaagttaatgtgagggaaaaggaggtacaagagtctcgtctctagaccttgaagacactccctgttggggtcttataatccttggagtgccgcagaatcatttgaaaaccatcttgatgtactactctgtgtttttaaataagataataggattatagaaacattagactggcagcaataagttggattgatttgaagaagagaaactgaagaagggaaagggtatcgatgcagctattgtgaaattctacagttgagattcctgacctgattggactggctcagtgggtgtcatagaggatttatttgggaggatttaagttcaaggcacatgagtaggtttaagtcaacaacttgacactgtcaacatgaaatccacactgtaactataagtccgaggaagagccctctcctgaagttaggaatttaacttcagctcttgcattttctgtcccaccggtcatccatttcttctctatccatctccttttctgatatctagttgttatcagtgttgttgaaaagcttaagtatgattcatattcactgtctataaagttcactacacatagtcatgctgtaatgcatacccgcctgaaagcatctggtctctcttttccttctttccaaagataagaataccattcacagctgtttagaatagaaattttatccaaattcttcagtgtttatatttttgttctgttatttcagtgtcttgaatattgtcaaatgacatttattagctactactggtactactgaatcttaataatcaatcttcaagccattaactgaccaatggtttcttctatcttaatgtattagtaattattcatttagagtaaaacatctcccagaacatgaaagaatacaaactttattcatgttacgttgtgacaggagactttgttggatgcgcctgattttcctgccaattcacagcttcattaaaacagtaatgctttgaaatatggcttaggaaacttcacaatgatcattaattacacctaatttctggaagagtatatgcatgtatgtgttgcggtattctcccttgctgtggcaggatgtcacaaatttttatccacattacgaaaatttaaaaattgatatggttttttctccctacgttgatatcagatattttgttttatctgacagctggcccaatgtactcctactttgccattataaagaattcaaaagcttcatatttgcattgaaagttctcaaacactttgtaaagatgatgaaagtatgtttcatcatctatgtagaatagtcaggtgttcttgcaattgattacttgctaccgagaattgaatacctactgagtgcataatgtatagaattctagatattcacttttgtgtgtttttacagttgttatataccttagtgtggctctaaaagtggaggtgacagctgtagctcttaatgtcttacactgagtgatgtttagaatcttaaattttcttttataattttagaaaaaagtatacttttctttcttatttttataaccagatccaaacacatttgcatgtagataggcatttttagtcttgaacattcatttttacttttaatcctcacttttattagtttcgtatctttttgtatttcatttcccctttcaagatgccttgagtcctttctttttaggaatgatgttgtgaataaattatttgataaaatgtctttacacctgagagtttataaggatagtttgaaaatcatgtctgtaaaataggttgatctcacctaaaaataataccatataattaaaattagaattattattgtgttgcttattgactcttacatatatcaaaaaattgctgagtcttattcagccagagcttttacttagtatgatattcattcctatatttacttttttctcacctttctcatactttcttttacttactcagcattttcctcctttcctccctcctttcttttcttctttccttcttttctcttcctttcgtattcctggtccatcttagcatgtaatctttctttatgaaatggcatgcagataggtctactgttcttacagtaaaaaacttcaaggcctcatgtctttcccacttctgtttcccattcacaacctttttagctgattcttttggtactttaccactatatcttgccatagtttatgtacctggctcctacttaattttttgtttatttgtgtattagtcgtaggcattatttatcgactcttctctctgaaagatgaaaggttagctctctttcacattcttaactgcccttttttcttaccttgtccatgtatttctaaccccctttcctcctaatatgtttatgtcataattttggctagattagtgtatacgatttacataattattactctgtaaatgctttttatgatctctgagccatgtagtatattatggctatttttctttcttatctatttgtatttttattgttattacctaaaaaaaaattttctatgtcttatcactaattcttccctaaaatttcccacaattgtgtaaacttacctcagtatattcatagatatgagacattctatcaattttaccctcttaaagatgcagagataatgcattatgtttcatcccaccatctttaatgagaagcttccatcttagattaatattagagaatgttaaaatactctgcaatcaggtaaggacgcttgaaacttcattataatgcaaaagttttctttaacacaataaatattttgaaccctttttgtgtcttgtattcataggagttcagatagaccactttatttactattttttatagagagtgaacagaaatcccatttctagtcaccagtccttaatctgtaaatcaggcagataatctgtaaatgattggttgaaatcacattgaattccactttgtgccagggacttaagttaacgaacaaattattcttacaaaaaggtataaatgtaaggttttcattctgctaaatatgtttgtcaaactgtgttgtgatttgttctcagtgtgtcatagctaccatagcttttggaatgggcattaataaagctgacattcgccaagtcattcattacggtgctcctaaggacatggaatcatattatcaggagattggtagagctggtcgtgatggacttcaaagttcttgtcacgtcctctgggctcctgcagacattaacttaaataggtaaaaaaaatttattgtttttactcttgcagatttctttctttctttccatataaacctcaaaagtgtttgaggctatttccagtatcccaagtaatttgtgagtgcatttaaagtaaaaaaaaaaaaaaagaaaaataaaacctccccaaatccagaggacatgtaagaagaacatttgtggtaagagttgccacttggagatgagctaatttcagcatgccttagttagtgtgaggaattaactaaatcaggacaatacttgggcctgtcacagagatcctatggaatactttcctaccattgtgcattaatgaacaggttcttttcctctcctcagatcctgtcaagttgcgatgtcttcagccatagttacttcaactaccactgattttgttactgattctttcttcccatgctacagtggtgattattccagaggatttctctcagtccctatttgactcttgttactatttgttttcttggttagttccatgagaccatgccagttctccttgactgtgtatgaatcattgtgttgcactgtactgacagactgccgtaagtcaatattaagtgttcagtatctaagtgcaggagaacctttctacttaagtactcaacaagtagtttgttggcacttaagttctatgagattttttgttgtaaaggaaaacattatcttgcaaagattttggggcagcatttaccaatactttgttccttcatccgtaggaaaaagaatctcaggagaaaaacctatacatggtaaccaatggggctgccaagctgatgaagtattttcagagtacacctttgtgtagctgaataaattgagatcttgaatggacatattagctcattttagtaaaatgataagagagtgcctcccactacagtttttgtttttatgcatcattaaacaatgtgtttttgattgtccactgtgttccatgaactatgctatgtgtgggagatatagtagtaaagaaaagcaaagtacctgcttccatagaattcagtataatgggaatggtaattctttagagaatcacataactatggatacataggcttcattttactgttctccttttgtgtttgaaaatgtcaacaatcaaaattttgtaaaaaaggaatcatgcaacatatttaaaattataactgtgttaagtgtaatgaagggaaattgcactgagtagtaagaatatataatggtgtgtggtatttcccaagttaaaaaggtcagataaggcttccttgtggaagtgatagttcaaatctgaaagaagaataggaattaattaggtaaaaatgtttgatgcaaattttaagattttccttctgagtagtcagtagcttttccttcttaacatagaagatgacaaaaccatcctttttttgtacataacaattcttgttttcctttagacagttgtatctgtcaagcttcttatgatctaatttaaataattgggatagaacacagctgtacatgttactattaaatatggaatatatcaaacataagttgattcctaccagttctgattttatttgtgtattttgttaaaggtactgaggacattaatatccagttttatattgtgcatttgaaggttcatcaataaatacaattcttgtttctctgggtcttaaaagatattttaaatggttatctcattaagatttaacaggaaataacagtgattcaaatcaaatagtggtgccagaaacccatacttgaattttgggtatagacaggttaccctttgcatcaatcctgaggaaactaaaactataggattaatcaggataaaaaagaattgagcaaggattcaggagggatctgtatcatcctggtgacaaccctcttctagaaaaaactagaaagtctaagaataaatgaagttgctggttctcacctggaaaggtcagttactcacaaaatttttagagtctatcttatgccataattctatcactgagagaagaaacttgtccagtcatcatgtaatcttcatgtaaatttatgtttttaattgcagaattcataccacaggcaaagtcccaatgtctgcatttgctgttaccttaaatagtcaaaccccaaagttattgtaatctttttttaacagagaataatttgcagagtaatctcggtccggtagatctttcagtggatccaaatgattgccatgaatggtttagaatttttttaattttcaagttgtttttattctgtggaatactggacttatttttgtagtcccaaaagaaaaataaatatttatttatttgccgttaagagttgtagttttgttttctcaaatttgtcctgacactgacgagattagttaaatgtaggtcatctgaaccaaatacaaggaaggaaggacccagttctgaagagtgtgggcatttcttttcttgtttttttttttttttttttttttttctataggaggggaacgaggtgaactaaacaaacaaaataaagcaaaaaagaactgatttttatcccttgaggtagaaagaatgagattacagtggacccccttgtctgcattttcactttctatgttttagttactcacaaccacgtccaaaatgttaaatagaaaattccagaaataaacaatttataaattttaaatcagtggtggctttgagtactgtaatgaaattttgtgccatcccactcagtcggcctcgacttcccttagaatcatccctttgtccggtgcattcacgttgtatttactccctgtctgttagtcacttgttgcagtatcacagtgcttgtgttcaagtaacgcttattttacttaagaatgaccccaaagcacaagagtactgtgcctaatttataaattaaactttttcataggtatatacatataggaaaaaacataatacatacaggatttggttggtactattctgcggcttcaggcatccactggacgtcttggaatgtatcccttgtggataaggaggaactgtatatggttaacctaggagctagagtcaacagttggaagagactttggggataattacatggaagggcatggtgggtggtcgtttcagatgacaagaatgtttttgaataacggatcatttgtgtcttcagactttccagaactccttgagaattatgcagaggtatttaatcagtcagaaggttgaatagtcaaattattagtgagtgaagtctattttgatgaggattttactaatgctgtcccttagatattataagtaaatcgttgttttcttttgaaatatctgaaacctagttaacatggactttcatttgttcttgtaaagatatgcaaagctatttgggagattgtcatcatctgatatttgatattcatgggctttcttcacagaagactagaaattaacagagtcatgatgaattatggctgcattgactttaaaaaacaaacacctccttaatgttatttaacaattttgaataaatttgatatggcaaacaaatcagttataatcgattgagaaaggaacttaattctaatacttgactggtgtcccataataacccataatactaagagacagttttggagggcgagaagtcctgaagagctgatagagataaaggttcaaatttgagcttctttcagtgttccttacgtcaatgcttttagtttctcatacaaaataaaataaagaataacctttttactgggaaaaggtaaaaattaataaattgtagaagcattgtttgaagccaaaaagtgtgtgacatgtaaattgaaatgaaaaaccttagagtttttgatactttttcaaagcagctaaagaattgatacttggacacaggaagaattttttttcaaaagcaatttttataaaatcagaaaaatgtttacctcttgttgggggcattgactggaaaggaatacaacagaactttctgagatgctagaaatgtttttttatcttgatggggtgtgggttttgtagataatgaaaaataaacagtaaaaaataagtaaaaaaaaaagtaagaaagttgccaatacagttttacatattcctgtgatgtttttaatcgacaggcaccttcttactgagatacgtaatgagaagtttcgattatacaaattaaagatgatggcaaagatggaaaaatatcttcattctagcagatgtaggagacagtatgtattatttattttatgccaatagtatggatttatggatgatgctcttttaagacaacaatttggctaaataattatcagtattttgaaaaaatattttgttgctgttacatgtgtgctgaatttttaaggctaacttctttgtgtctgagtaaactgaagtcaaataatgaagtcccaagtgaatcaattaatggtgattttacctcattattttcaggaatgaacttaacatatacgtttctgttcttttatttaatttaaaattttgtcttgggtagaatcatcttgtctcattttgaggacaaacaagtacaaaaagcctccttgggaattatgggaactgaaaaatgctgtgataattgcaggtccaggtaaagatttcttattatagatggacattctaaaagtctttctttctcttccttttcatgtttaactgaatttttgttgaatgataagtatttcagttttttaaacaaaacaatgaatgtgtttagatatgagaaagcaaacaatattaaagtattttgcttaaaaaatagataaagcaataaaatggtagccctaaatctaaacatatcaatagttatgttaaatgtaaatgatctaaaatattatttaaaggcgtaaattgtaagaattggtttaaaaacatgaccctgttctgtacgttgtccacaagaaatccactgtaattatatagataggtttaaaaaagaatgaaacattacattccatgaaaacattaatcaaaaggaagttggagttactttaatatcagacaatggacactttggagcaaagaatattatcaggataaagaaggatattatatgatgtaaaagaatcatttcaccaatgtatcagtcagggttcaccagagaaataggacgattgatattatggagatatatatatatatatatatatatatatatatggggagggaaaggaagaacaaatatggggagagagggatgaggcgactgattttgaagaattagctcacgaaattgtgggggttggcaagtctgaaatttgtagagcaggtcaataggctggaaactcaggcaagaggtgatgttgcagtcttgaggcagaatttcttctctagcaaacctagtttttgccctttagtcctgccactgagtggatgaggcccacccacattattgacaataatctcctttacttaaagtcaactgattataaatgttaatcacgtctacaaaatattttacagcaacatctagattagtgtttgaccaaacaactgagcatcataggctagccaagttgatgcataatattaatcatcacaaccaagaagacatcatcctaaatatatatatatatctacttaacaaaaagactgacagaactgaaaggagaaatagagaaatctacagttacatttggtgacttccagcatctctcaataatcaataaaactgacagaccaaaaaatcagtaagaagacagaagaaatgaacaggattatcagcatgctggatctcattgacctttttagaacattctacccaacaacagtagagtacacattcaagtgcagatgcagtattcatgaacatggatcatattcagagtcataaaacaaaccttaacaaatttaagaatcttgtatttgtatattttttgactagaatggaattaaactagaaaacaataacagaaagataacagaaaagtctctaaaccttagaaattaaataacacacttataaataaatccatgagtcaaagaggaagtctcaaggcaaatcagaaaatgttttgaactgaatgaaatgaaaatacaaaatgtgtgagatgcagctaatgcaatactgagaaggaaatttatagcattaaatacctatgtaataaaagaagaaaggtctcaaatcagtacctaagcttacatcttaagcaacaagcaaataagagcaaaataaatcaaaatgaagtaaacataaggaaataacaaagaacataagtcaatgaatagaaaagctatggtcataccactgctgtccagcctgggtgacagagtgagaccctatgtcaaaaaaatttaaaaacaaagcagcatgcagcattcattgtcagtgaatagaaaatgggaaaacaatagagaaaatcaactcaaaagctcattctgtataaagatcaacaaaattgatataaacttctaacaagactgacggaaagagaaaagacacagaagaccaataccaggaatgaaagagggaatttcactacagacctcccaggtattactagggatgataagggaacactatgaacaactcagaacataactttaataatttagatgaaatggatcaatttcttgataatctcaagctaattaaacttacagtgaattagataacctgcatagtgttacaaccattagagggattgaattctatgttaaaaatctctgaaaataaaatcccctagcccaaagaatttcaatgacaaattctaccaaacatttagaagacaaaataataccaattctatagcatgattccatttatataatagtctttgaaacataaaactatactagagggatgaagaaaagatcagtggttattagagattgggggagggagaaggtatgattccaaaggatagtacaaggcagtattttggagtgatagatttatcgtgccctgattgtgatgggagttagatgaatctatggatatcttaaaatgtgtagaactttacacatacatacaaccaatttgcctatgttaattgaaaaaataaaataaaaacaaattatttacctggtgggttagctacgtacctaagttcaatagctgcgttactgtaagacaaaagaagcattattagggatggagttgttctctgtgtaatgacaaatacttccttcactaagaagacagaattgttttatgcacctttaaaaaaaaacaaaaacaaaaaaaatacaaccaacaaacagtaacttgctggtgcggtggctcacacttgtagtattagcactttgggaggctgaggtgggaggatcacttgagaccaggatttttaagaccagtctgggcaaaaaaccgagactgtgtctctacaaaaataaaaaataaataaaaaaaattagctaggcatagcattatgtgcctctagtcccagctactctggaggctaaggtggaaagatcgcttgagcctggaaggttgagactgcagttgcagtgagccatgatggcaccactacactccaggctgggcatcagagtaagactctgtctcacataaaaaaaataataataatgataaaaactagtctgggcatggtggctcacacctgtagtcccagtcctttggaaggccgaggcaagagaattgcttgaacccaagactttgagaacagcctgggcaacatagcaagaccccatctctatttaaaaaaaaaaacaaacttaaaaatccagcaaatacataaagcacaaagccgacagaagaggtggagaaatcaacaaatccaccatcaaagtgggagaatttgatataattttaagttattggtagggtaaacaatccaaaaattagtacactgtagaaaatttggtcaacatagtaataagtttgcttattactatttatcagtatacatagtatactgatttatcagatacatagtatatggagccctagagcaagcaactatagcagtgtatctcaagtatttttacttcatgacccacatagcaaatgatatgtgtatataacacactgggctaattgtcagagttcagtttctgtccaaaaccctaagatctggagtgattaacctttcagcactcttagaactcacttgtttgtagcacactgattgagaagcactgaaagacttcactcctcaaacatacatggaatatttctaaaaactatgtattgggccgggtgcagtggctcatgcctgtaatcccagcactttgggaggccgaggcgggtggatcccgaggtcaggagatcgagaccatcctggctaacatgatgaaacgccgtctctactaaaaatacaaaaaattagccggatgtggtggcgagtgcctgtagtcccagctactcgggaggctgaggcaggagaatggtgtgaacccaggaggcggagcttgcagtgagccgagatcgcgccactgcactccagcctgggcaacagagcgagactctgtctcaaaaaaaaccaaccaactgaacaaacaaaaaaactaaaaaacaaaaacaaaaaaactatgtattagagcatgggttggcaaactatggcctgtaggccaaatctgcatgctgttttatttttttttatttttttgacatagggtcactacaggctgtcacacaggctggagagcagtggtatgatcatagctcactgtaacctcaaattcctgggctcaagcaattctcttgcctcacctcagcttcccaagtagctacaggcatgcactaccagacccagttaattaaaacaaatttttttttggtagagacagtctcagtatgttgcccaggctggttttcaaactccttgcctcaatcagtcctcctacttcagcctcctaaagtgctgggattataggcatgagccatcacgcttgactaatgtttttgtaaataaagttttctcagaacacagccatgccttttgtttatgtgttatgtagggctgcctgagttaagtagttggctacaaagcctatcatggcctataaagcctgaaatacttactatctggtcctttatagaaagtgttttctgaccctgtactagactagcttgtctcaaaattcttcaatgaatttggaagttttctcaccacattttctgaccataatgcacttgagttagaagtaaataagcagataaacaacaaaatcctcatgcatttggaaattaaaaataacacttaaataattcatattcaaagaaaaaatcaaactggaaattaaaaaaaattttaaacctacagataactacattaatatgcattaacatttttagaacttagggatagttacaatgatatacattaaaactggtaagaggctgggtgcgttggctcacgcctgtaatcccagcactttgggaggccgaggctgggggatcacgaggtcaagagattgaaaccatcctggccaacatggtgaaaccccgtctctactaaaaatacaaaaatcagctgggcgtggtggcacgcgcctgtagtcccagctacttgggaggctgaggcaggagaatcgcttgaacctgggaggcggaggttgccgtgagccgagattgggccactgcactccagcctggcgacagagcgacactcttgtctcaaaaaaaaaacaaaaaaaaaaacaaaaaaaaaaactagtaagagggcccagtggctcacacctgtcattctagctctttgggagactgaggagagaggatcagttgaggccaggattcaagaccagtctgggcaacataacgagaccgcatctctacaaaattttaataacaacaacaaaaaaactggtaagaggcaacattgaatagtactttgtgggagtttattagcttgaaatactcataatagaaaagaaaattaatcagctaagcatctcactaaagagattaggagaataaacctaagcatagtttttttcccccaaacattattatatctggaatattgaatgcattcttattgctatttcaaagatacttactctaaggaaagcaattgaattaggtagttgaactctatagtagattttctttaatgagtccttttgttctcaacctacttaaataattctcatttgaatttatgatagtttcagatctacccaaagggtgacttaggaatttaacttctaaatctatttaaatgaaaggtttataatctttttgtcatattttacagtcgttagcgtttaacaatttatagcataggatttgggtttttttttttttcattttaaagaagaagtttatttaagcaagacacttgactaagggaagactatcttggagttattattactagagtaatttatttctacttaaagacagattgccccacaagtaacagctacataaaaacagttgtaaaattgtccttggttttacaatgataaatgaaaaacattaaaattctctaattgaacaaggtatgcaaggatttttatattgttttttgctaaaactatgacagcaaaataacatcctggagtataaagataagagctgaatgagcaggccactaggggacaaagggagtcttttcacagaaccaatgcttcttttgcccaccccatctccatcgaagtcaatctaaacatattattggccatttagttaaaaaaagaaagaaaagaaaagcaatatgcttgtggacatacaccagttactttatgtgcaataaaagagtaggaaggggaaggtgaaagaatagagaaaactatgtagtcaggatgtggtggaaccaaattgcaactttcttttttttttttttttttttgagacagagttttgctcttgtcacccaggctggagtgtagtggtggcccaatcttggctcactgcaacctccgcctctcagattcaagccattctcctgcctcagccttctgagtagctgggattacaggtgcatgccaccatgcctggctaatttttgtatttttagtagagatgggttttcaccatgttggccaggctggtcttgaatgcctgacttcaagtgatccacccgcctcagcctcccaaagtgctgggattacaggcgtgagccactgcgcctggccaaattgtagctttctaattgagactgtcttcttggtctggaagagcagagttctgcagtaaaataacaggtcccccttttagtagacatctccatgtctgctgctggaacacatcagttttgtcttaagcctcacttccaaatgtgcagatgtgtctggttcattgattggctgcctgtcaaattgaaacctgatctgcctcattggcaaaccgtgccccttacaataggctttcattggtttactaagcggtgtggtgcgtggctgttcatcttaaactgcaccacagtttaagatgaaccttcaaatgaacattatccttgttctcagtcttgactttccttgggctttttgtggaccctggtgagtgtggcagtctcctcagctgctgcttcacaaaagaggtaccaggtctgccccgaatgagtgagcccctaaacaggaccaggagtggcagaagaaagaggcagcaactgagatgtgttttttctaagctgaaaggctttttttttttttttttgcaacacacctttaacactaaagtccaatatttatataattggtcaagtaagtggagctgttctagctataaatatggcaactctgcttgctcgtcctattattgacattattcctttctgtggtctgaggtgcctcccatgaaacttgcttctaggacactaggattgagaaccatcagcgtaacatatctgttacgctacaatagtttattttcatattttagctactttacatactcgggtataatgaactttattcatagcttctgaagcagttggcacatttgagatattttttacttggctaattgttatgctaaatcttttgatttctaaagatacatgcctttgctaagctttcttcaaatgttattatttttatttagattggatcattgctattccatggatgactcagaggatacatcctgggactttggtccacaagcatttaagcttttgtctgctgtggacatcttaggcgaaaaatttggaattgggcttccaattttatttctccgaggatctgtaagtatatatctgtgaattcccttcatagatcttcttttacttctattacacttttcttcagaggtttgcagtattatgattgtagctttgacttcagatgggtgactaggaactcatagagtcttactaagttccagttaaacactacattcattactttggataaaacccgtgtgtatggcatcttctgctgttttcatgttcaagccgatgttcagctctgcagctcagtctggaagcattgtgttaatttatcacattgcatttgggtgaatccctagactagtcttgcttaggataattaggaaaagttaactttcattgtatcaagggacaggtagaacaaaattgtccttttgtccaggaaactattaaattcttcaaggaaaactttagttatagggattattttttaaatgtctaatttcagtaacaatatttgggacatatttatttttccttctgtttcctatcagaagtatttaaagttataagaaaattgtggtttttgcctttactaatgaataaataatcaattaaattcagttacttttttttggagtgattgatgttccagtattcttctaaacaaccacgggtacaaatgtgaataagataggaccgttgcagtccaagagcttgttctgtagtcctttcctttatatgattttttcccctgatttagaagtctataaagcaaagctaagtattacacactgataatggctgaataaatcaagagcaagagataggatactttgcaaatatgcatatttattaaaaatgtactttaaaatagagattaaaattctcgtattgaatgtagaataggtaagcatttatttgtgaaatactcgaatgcttcatgtaaatactttctgagtttgtatttttagaaaggaacattttggaggctgaggcaggagaatggcgtgaacgtgggaggcggagcttgcagtgagctgagattgtgccactgcactccagcctgcgcgacagagcaagattctgtctcaataaaaaaaaaaaaagaaacatatttattaaattagttgtgaaatatttttaatgaaatatattgaaaacttctgttgatttttcatgtactgatgtttttagattctaaatggagtttaaaattttgtttgtaaatcacaagttggattagaaatttaatagtagaagtgttgcctaaggactattttaggtgctgtgagtgaaactgtattttttataacaagaattttagttgtaagggacagcttaaatataattgagatctgtgaaaatgtattctgtctctatcaccttcagaacctgtgtatctcagttgaatgtataatttataaaaattattcttgttttaatttggtgtaatccagccatatccagtatcaacaaataagtctaagtaggctccttgacaaacttgaactggccacaagagagatcagatttcacctattaaaaaaccaaatcagaccacttacactgacagtctcttctgggagtcctcaaattaagaagtctatcctttgtgaaatattacactacccttgctagataaaacttttctaaaagtaccacttaatgaaaatctgtagacactaaatgcaatgaaaataaggcattgtttttttttctccccatttcagtgatcttggtatcctgggatattgtttttaaaattatcgttataattcctttgagaatttagtgaaatgttccctttaaccaacttaggaaaaattaatatctttgtacatgattttgagctgtaaaataaacattttaaactgggaataattggagtttagttaaagagataatgtatataaatatataacatagtagcagcatataattctgtcttacacaagatttttctgaatagtataaacagttatgtagcctatctaggagtttgtgaatagagtttaaaattttgttttgaagctgcaaatttgattagaaattaaacagtgaagttattacttaaggaacttcgttttagctgtctgaacaacttactgtataaaaatctttaaacattctgtataaatatgtgataagatatgcaatgaccttaattttatagattagaaaataaaaacacactcattaatttacataactgacagattaagtgaaacttctcttctgatcacgttagcagaatgccaaatcttgtcgtggcactagaattagacggtagttttgataatacatgatttgactatagacatttgttgaaactattggtagttttaatcactcttgtaattttcaaactatctaacgggagaggattatccatcctgttttctagacaaactgtttcatctgaatgaaatatattcctagagataattatcactacttcatcttttggttttattttgcacatagaattatagttcacaatgactttctgaagctctaaagttgcagctgtgagcttctttggcctgtagggactgggaaaaagcacccccgtcctcccccaagcccccccaccaaaaaaagttaaagtgtttttaacaatagctgtgggctttttgtagtttcagaacttaggagttgcccaggctggaatgcagtggtgtgatcatagcttgatgcagccttgaactcctgggttcaagcaatcctcccacctcagcctccagagtagctgggaccacaggtgccaccccacccagctattttttttattttttaatttttttgtaggtatggggtctccccatgttgccctgcctgtctcaaactccagggctctcaggtgatacccaccacccttggcctcccaaagcaccgagagtcactgtgccaggctgagtttaaaatttcttgagttggagtttatggctattttttccactagttattaaacatgtatttttgtataaggcactgtattacattttgtggggggattcaaagctaaattagatgagacgcatcatctattatggaagatgttacttaagaagaaatgagtgtaatgtagcagagaattagataagggacgtatgaatacatataaatgctgttgaagttctgaagagagagagtgtttagagaaattagaggagtctttgtgaaggtatcactagaacttcctatttttgtggaatatatagtagattttggtgtgatactgtggatttggacattcactcagagaaggaatgagggaagaatggtggagaagaatggcattcacagtacaaaaagcaactgtgacttttaaagaagttaatatggagaagtggcaagtcttttcttctctcttctcttctcttctcttctctcttctttttcttttttctttttttctctgtcagataccgttgtaaagactttgcttttaccggaaactgatacgttgggtcatgtaccctggccagtcagttctctttattctaacacttagccgatcagttagatttccacattccatgatatgtcagttttggtgacccttatttttccacctggtttataaagggaaagaatgtgatatgtcacccaggctctggagtacagtggcatgatcataggtcacagcagcctcaaagtttccagttcaagcgatcctacctccttggcttcctgagtatgtggcactacaggtgcatgccaccatgcccagctaacttttttgtagagacagggtctccctatgtttcccaggctggtcttgaacccctgacctcaagtgatccgcccaccttggcttcccaagatattggcattacaggcatgagccactgtgccggcctgaaaatttctcttttgagatggcatcccacagaagtatacctgcttagagctaacactggtaaaaagactatttaaccctattgccttattttactgtagttgagattgagttaaactgaaagctgaatgacctgtcctaggtcatactgttactttgtgccagagtcaggatgagcaaatggatttcctgcctgctagtctagtgtcttttctatttattgtgctgtaacatacagttttaaatttgtatttttatgcccaatggacatggtagctcacacctgtaatttcagcacttttgggaagccgaggtggggggattgctcgagaccaggagttcaagatgagcctgggcaacatagcgagactccgtctctataaaaaaaaatttaaaaattagctgagtggtgatgtgtgtgcgtgtagtcctccttgtgggaggttgaggtgggaggatcgattgaatctaggaattcaggactgcagtgagccatgattacaccactgcactccagcctgggtgacagagcaataccctgtctcgaatgaatgaatgaatgaatgaatgaatgaatgaatgaatgcccaaatccgtaagctatgttctgtatagcagctttttcatcataggcagtttttactcttatcagtggacaacctacaaaattaactaaacacttaagcaattaacagaggaggccttgttcagagtgagaaatcattaagcatttgttgttgaaatttcttactgtactctgttttaattctgtttttttttttttttaatgttacttgttttagtttggattcctagttgaaaagggaatatgattcctttaaaacaaagatactctgctttaaagcaaaggtatatcatcctcttcatggtgattgccatggaaacaagacaatgtaaatttattcaaatagtacacagtttttatagttattgatcatgaggggaagggacagttaatccctactgatcagataaaacctcattgtttcatactaataaatggtttttttatgcttatgaaaggaaaagccagaagtgtaatttttagtgtttagagagctagtgattctagttagggaacttaatacctttgaagttattagtttgcaagcaatagaatctactactaccaaggtgacccctagcagatgtagagtaccattaacaagtgttccagggaaggaaagccaactagataccaagtcatgctttttactcttagattaagaaattcaggttgagttaaaggatcagctgttaactaataaaaagcagattaatattacagagccaggctctgtcctggttatggacttaatcttcacagcatcctcaagagataaaaatgaatatacctgcatattagatgaggaaatagaagataagtaacttgccagagctatgacgtgaactcaggtaatgtagcttaagagcccccacatgtatgtatattgggtgtgtgtgtggagggggtgcgtgtgagtgcttgtgcatgcgtgtggtataataagaaaaaattagcatttatgcctgtaatcccagcactttgggagaccgaggcacgaggatctctcaaccccaggagttcaagaccagtctaggcaacatagcgagaccctacctctacaaaaaaagttttaaaaatattagcgggcatggtggaatacacctgtagtctcagctgcttgggacgctgaggtgggaggatccttgagtccaggagattgaggctacagtgagctatgatgacacctctgcactccagcttgggtgacaaagagagaccctgtctccaaaaaaaaaaattagaactagttatctggaggcctgtgttctagtcctagctttagtacggctacacagtgacacattaggctaccatttaacatctttgaacctctgataatttgttaacaatatgggtaaaaatgactaagataaatcaaagagctccagcattccctccagctctgaaattctatgatgttttatcttattttacttacaaaaataaattatattatgtatatttaaagtatacaatttgatgttatgggttacctatagtaaaatgattactataatgaaactaattaacatatccatcatcttatattgttaaccatttttttgtttttgtggcaaaagcagctgaaatccactcatttagcaggaatcccaaatacagttcagttgtattaattgtaattctcatgttgtacattcgatctctagacttgtttatgctacatatgtttgacttttaaacattctactcaaatcaaccctaagtcagggttagcacagacaggacttgttaacaaggtagaaggtgccacattgtacctgggtgtttatatttctctaaatcttgttctgatcatattttaataaatataatcatcaggacaccaaaattcattccttagctattaaaaaattctattctattttattgttaagatttaggagagcatggtacagattctcttaactatacctatcagaagcctatgttttaagtccaatgtataggcactgctctgtttgtctctggtgggaacttaccctgctttacctaatttcatcctagcttcctttttgtgaaagatcacccttgcttagcctattttttggcaaatctacaccttggaaatagtagtaaatgacataagcatattaatatttatgatgtgatttatttttgttttcaagtcatatactggggaagattctcaaatattaaaacaatgtatctttacatttatgtatgtcgttcttgttctgttttagaaggcttgtatttgcatttttaacattccaaaaggtaaacctgtaatcataatgttttcatcaattcaataaaaccattacgtttgtaatagagagccctatagttgccttagttaagtttgctgcaactcattttatatattcttttaattttgatccctggatttttaattgattattaaaccttcattaggatatatatgaaatgtaaaaatattgagttataatctaccgttttctaaaattttatactgcatttttatatagaaattcaaattgctcataatcattctagtgaatttaagtagaaaggtatttattactaggtattaaatggcttataatattgttgacaaggttccactgcaaaatagttcaccaagggagctgtggcctcttctgtgatcaagaagccatctgtcaacttgggaagcttccactatagcacctaaccccagactacattgagtaggaagctgtaataatcaggaagcttctacctttgcatgctctgcaaaccaacgtgaacctgctgtaatttgtaaccacaaaatggatgcctgttgatacttacgaagctcatcattgtatgctgggttctttgctaatactttcttataaaaattaaatacctccacaatcatgcatgctagcagaaacagcagacgagtagccttagcctcacttcctgcttatacctgtcatgcaaatatacagaacccagaaccctagctgaaagggagtttgagaactagtatttgtattgtcccagattctgcagtggaagaattcatagtggatggaagttagaatgacccttgaattacaatcggccacattcatcacaaatacattaaataagagtaatttgccataaagctctatgtttgtatacttctttgttttttttttttttttttttttttttttttgagacagggtctcactctgttgctcagtctgtagtgcagtggtgtcatcatagctcactgcagtcttgatctcctgagctcaaacgattctcctgcctcagctcctgcttcagcctcctgagtagcggaacaacaggtacacaccaccacactttgctaattttttattttttattttttgtagagatgtgggtctcactgtgttgcccaggatggtctcgaactcctgggcttaagtgatcctcccaaagtgttgggattacaggcatgaaccactgtgcctggcccatatactacatatatttaaaagtagtatttaaatgtgtaggatgaatgaaagaggcagtaagagaacaaagtgaatgaaaaagtatttctatatgaagtgaaagcaggagagtcctctctgttagagaacaacagaattgcatatgacagactagctttcttaatatttctagaacttgatggctgtgaagagcgtcccgtaggaattctcccttcacttaggaaaacatacctcaaaaccatcagctgtttagcatgcacctgcttttcctggtatatctcagtgaagcagctaaattgtaaatgattaagtaaactttgcagtgtatcatgtgcaaaagcacagtaaaaacaaaaatgcattggaagctgtgagttgttgcactgcactcatggatgaatagctgttggttcgcattgcgtttttttgttttgttttgttttgtttttttgagatggagtcttgctctgttgcccaggctggagtgcagtggcgtgatctcggctcactgcaagctctgcctcccagattcacgccatcctcctgcctcagcctcccgagcagctgggaccacaggtgcccgccacaacacctggctaattttttgtatttttagtagagacggggtttcaccatgttagccatgatggtctcaatctcctgacctcgtgatctgcctgccttggcctcccaaagtgctaggattacaggcatgccgcattgcgttttatataattctcatggttctagtctcgagctgtaggattttgatcactgtttcaaacaataatgtgagtttgctaagaggtctaaataacaaaagctaagtgttccaaacacatatccaaacctatacactgggcaatgcatctgaattatatgtgaaatttcctgccattatttaagacacaaaaggaacattattttgataatgtatttatttgtgagtggagtgttcagaatgagcacgatgggtataacatttttgtaggtttttaaagttgaaatttagtgtaaatccaaagaatcaatagacaagtctgtgttttacttaacctatatgtttaaattagcatttttagatactgattttattcctaatttcagaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaaggtaaacggtgtaggagtctgcctgtttgacttaattttgtttcccactccacattaaaagatcctttttgcttttaatagggtagaaattggcttcataaagctaatacagaatctcagagcctcatccttcaagctaatgaagaattgtgtccaaagaagttgcttctgcctaggttcatttttcagtttttttcttgtaacttctgcattttttgttgctatttatgtgattcaaattataccagtttataggcctctcacaagtaaaatgaattacctgtttgtttttgtatgcctattttagtcagtttgggggaagggatctgtgaggaaaggataagtcatagagcacttttcttttttaagagacagagtctctctgtgttgctcaagctggagtgcagtggtgcgatcatagcttactgcagcctcgatctcgtgggcccaagtaatcctcagccacctgagtagatgggactacagacatgcactactatgcccagctaatatattttaattttttgtatagagacagggtcttctagtgcttcctaggctggtcttgaactcctgagctcaagtgatcctcctgcctcagcctcccaaactactgggattacaggcatgatccaccgctcccagccagaacattttcttggttgatgggaagtagctgaccatggtatttagaaaacttctttctcatcgattaaagaagcagtactgaaatcaatgcggaggaatccatatatcatatttacttctggtgtgtagaagtggaaagggaatacatttgttgcttacttttttgtacctttacatgtgattgatcacttgtgagttttttctttcaaacatcttaaagcttccagagctttttctagaaaaaaaaaccagttttaagaatcaccagttctaaaagggtaatatcttattcatctttctgagaatggagtatcatgattcatgaattagatacttgcatcttaacatttgaaataatttaattttattattttttagttcgaaaactgtatcttcgggcaccaaagagcattgttataatcaagtaccagttgaattaagtacagagaagaaggtttgttttaaagaaattgttctgatttatttcattctttattgattcaaattctgtttaaaattttatattttaattcctttccaattaaagagaaaatggcatatataacaaagcataaaattcggccagggaagtgatgtgaacagactaaaatttattgtatataatttctggggctaataaagaattggaggtatttgagaaaggaattaatttgggttcttttaaacctatctgctaactcatttggcttagagtagtcacatgttataatacttatagttgatcaaaaaattgattcctaagtgttcttattaaagacacacacacacacacacacacacacacacattctctctctctctctctctcacacacacacacatgcacacacacttatgtactttcttgctttttttgacctaagatcttagataactattacagattaaatactaatccactggcagacttcagctaattagaacactggaataataggcaagcatagtgaattacattttctggtgaactttttctgctttattgaagtatgcagaatgtaaatgaattgtttttataactttggcacttgctgtatcttagaacattcttttgatgatttattttctgtagttttgggagagataagacattggaatgcgtttctaactacctttagaactttagaaactgataatttaggaggttattttcaggtgattaatttgacagcttgattaggcaaagaaaaaattgtgattttgagatttttgtttcttattttcttcacatttaaaagttttttgaaactttttttaatggacctttatatgtttaaatgcagtctaacttggagaagttatattcttataaaccatgtgataagatttcttctgggagtaacatttctaaaaaaaggtacagagttccatatttctatgttctatacttgctttatgagtacttttttttctaaagagaaagaactgtcagatgttgggctatttcattggcaaaaggaagttaaatttaaaacataagcttttcagtattagaatgatcaaagtgagctataaaagaataatgttaatttaatagctaacacttcttggatattactgtttgtcaggcattatgttaaatgctaagaactttatatgtgatatctcatttaattcttacaagagtctaacagctgttactatttatcgccattttatagttgaagataccaagggttaagaagttgacaaacttgttcaagagcatacagctaatggccgagctggctttcaagtctatatttgtctacctctagcatcaagacactatttatttttctttgtatgaaatatatacaggcatactttgttttattgtgcctggctttattgtgacttgcagatattgcatttcttataaattgaaggtttgtggcaaccctgcgtcaaacaggtcatattagccccattttccaatagcatgttctgttgtcatgtctttgtgttatattttggtagttcttgactggccattcaccatttctctccctctcctcgggtctccctgttccctgagatacaacaaaattgaaattaggccaattaataactctataatagtctctaagtgtgttttttttttttttcgagactgagtctcactctgttgttcaggctggagtgcagtagcacaatctcggctcactgcaatcttcgcctcccgggttcaagcgattctcctgtcttagcctcctgagtagctgggactacaggcgccccccgatcatgtctggctaatttttgtatttttagtagagatgggtttttgccgtgttggtcaggtggatcttgaactcctgaactcaggtgatccgcctgccttggcctcccaaagtgctgggattacaggtgtgagccgctgtgcctggcccatctctaagtgtttaagagaaaggaagattcacatgtctctcaatttaaatcaaaagctaaaagtgattaggcttagtgaggaagccatgtcgaaagctgagataggccaaaagctaggccccttgcaccaaacagttagtttgcaaaggcaaaagttcctgaaggaaattaaaaatgctaccccagtgaataaaacaatgataagaaagcaaagcaggctttttgctgatatggagaaagttttagtggtctttataggagattaaaccagccacaacattcccttgagccaaagcctaatccagagcaaagccctaactctcttcaattctctgaaagctgagagaggtgaggaagctgcagaataaaagtttgaggccagcagaggttggttcatgaggtttaaggaaagaagccatctccataacataaaagtgcaaagtgaaacagcaagtgctggtatagaagctgtagcaagttatccagaagatctagctaagatcatcgatgaaggtgcctgcactaacagactttgaatgtagaccaaatgctttctaccagaagaagaagctgtctagtactttcatagctagagagaagtcaatgcctggcttcaaagcttcaaaggacaagctgactctcttgttagaagctgatgcagctggtgactttaagttgaagccagtgctcaattagcattctgaaaatcctagggcccttaagaattatgctatatctactctgcctttgctacatacatgtaacaacaaagtcttgatgatacctgtttacagcatggtttcctgaatactttaagcccattgttgaaacctgcttagacaaaagattcctttcaaaatgttattgctcattgacaacacttagtcaccaagagccgtaatggagacatacaaggagactaacgttgttttcatgcctgctcgcttaacatccattctgtagctcatggatcaagaagtaaattaaccttttaagtattattatttaagaaatacagtttgtaatgctttagcttctgtagatagtgattatcagagatgggtttttaagaggttttccagaaaaccttctggaaaatattcactattctagaagtcatgaagaatatttgtgattcaggagagtaggtcagaatatcaatattaataggaatttggaagaagtcgattcttattaaaatcaagagtttagtgatagacatactgagtttgggatacctgtggagtagtccagaagttaatttaaatatatgggcttagtgtacagaagtgagcagggtgcttatatatgaataaatattattttaagatatatttaaattttccttaaaataatacctatacttgatataaaaagttaattggaaattagtggcttatgacaagcataccagcccacactcttcccaaacccactttgctcttattcatagaagctgtcatcttcaaatcttccagctgatttccctggcgtgtgccttcttatttctgaatgacacgcttagagtactatttttttgacttagcaattttagaaattttctactcatctcctattatggtagatttcccctccttcattcctcctccaatataattatatttcgtcatattaataatttgtttatatatatttttaatataatatgataatattgtatttatattattaaaactacacaaatattatatacacactactaacccaaccgtgttattatggccaccactacctttatttttttccttgtgttagtgattgtctttgttttattttcttggttttgagtattccttttactaattttcttttttcctatttcaatctctcattatttgtttactcatttggagtgttccttgacttttatcccctcttacctagtgacattttaattttagttatcaaatttttaatttctaagaatgcttcttgttctcttcttgtttcttcttccccaccagccaaaaatctatgatgttatagcaaggatcatacattgtttcccagtaggttaagaaaccttggttaaaacctgttgtatcccagtaagttaaaagacgttaacgtgtcatcttcagtatggatgaaagaatattttctttcaaaagcagttggttgaggaagagaatgggacaaatgctctttttaaaacaccaattttgtgatgaactcaaattgcaattttaactttaccattataatgaatgtatttgatccaaaatgtttaaaatctaggctgttgtcatttaaataacaaattaccttactggtatcatgaagaataaatgtttgtactgatttggaaagacattctcatttaggggatgaaatagaaagtcaatgaggagaaagaaaagcttttattatttattttcttttaaatattttagtatcatggtacagtcaccagaaaaagcttacagttcctcacagcctgttatttcggcacaagagcaggagactcaggtaaggcttttgtaaaaaggtaattagtttatgataggatagttatgattctatgtatgcttaaaattctgtattttgccagcattttaaaaattgttcttaagctaagagtctgagtttatatttcagtttatattcattctaaggaaaaatgtggtatctgaagctctaaaaataaaggactagatcttttaagtacactttaaaaagtgttgtttctttgttttttgttcagattgtgttatatggcaaattggtagaagctaggcagaaacatgccaataaaatggatgttcccccagctattctggcaacaaacaagatactggtggatatggccaaaatgaggtaaactatcttttgcatgtgttctcatttatttccttctaacaaaatagatttggaaaatatatctaagttgataatatgaccatagcttccactgtcacatctgggaggtgactcagattccccctgctgcgatgcttatctctttgccaagctttagtaccgtgtttctgtatgaataaaaaccagttacgttttcagcaatcatattcaatatttataaaatctaactcattatttacccaccctgcattttatccaaatgccgaaactcctctttttggattctttatttttgattatcttaccatcacatttgtagtcagaggttcctaatgcttaaaacctctgatctgaattttctctcctccaatataaaaccccttcgtcttcctcttcttcttcttcatttttttttttttttttgtctgaagacttgtctcactgtgttgcccaggctggagtgtagtggtgcgatcactgctcactgcagccttgaccccctggactcaagctatcctcgcacctcagcctcccgagtagctgggactacagaacatgccaccatgctcagctaatttttgtattttttgtagagacagggttttgccatattgcctaggctggtcttgaactcctaagctcaagcaatcttcccgcctcagtctccaaagttctggcactacaggtgtgagccactgtgcctggcctctttttctcatttaaatacttttcataccttttgtaaaacgggttccttgttgcctgtctatgccttcctcctccttcttaatgacaccacgttaattctgactgttttcccttggcctgttgcagaagcctcttaactattaacccttcattctctctctctgtttcatctgatatatgagtaccaaactaaatcttcctttatcatatcttacttctgcttaaatgttttttttctagcttagaattcaaggccctctatttatgaacttaaacttacttttccctctaagttacagaatttgaaatggtttatcttacctggattgtttatcacttgttgaagatccattttcaacttccatatatttatttacagtgttgcttctccttgtagtttccttgattcctcaaaactccttttaagaattcttgaagatctcgctttattactatttctcgctttattactgtaaagactatgagaaggtctttcatgatcttatcagcaaagtaattcctctctcttgaattcatagaggactttcagatgaattctaaagatgcttctgtagcacttaccacacaatgctatattttatttttttgtaattagtggtaaacaagtattattatatcttctagattttaaactccaaataaagatactagctccttacctttttgtgtgtctcctgtagcacctagcacaatgcctcataaacaggaggtgatcattaaatatttagaagaaattatttcccaagaatagttgcttggtaattgtatttgtcttttacttccttttaaaaaattgtttctgtcactaaattgcatccaatagatgttacttgagtgcagaattttctaatgacattacacagtgctacatctgacactaattcttttgttaaaaaataaatattctggccgggcgctgtggctcacgcttgtaaatcccaggactttgggaggccgaggcgggcggatcacgaggttaggagatcgaggccatcctggctaacacggtgaaaccccgtttctactaaaaatacaaaaaattagccgggcgtggtggcgggtgcctgtagtcccagttactctggcggctgaggcaggagaatggcgtgaacccgggaggcggagcttgcagtgagcggagatcgcgccactgcactccagcctgggtgacagagcnnnnnnnnnnnnnnnnnnnnggaatagctgggactacaggtgcgcgctgccacccccggctaattttttgtattttagtagagatgaggtttcactgtgttgtccaggctggtgttgaactcctgagctcaggcaatccacccgccccggcctcccaaattgttgggattacaggcgtgagccacagtgcctggcccagaggagatatttaatgaaaaataataatcattagataggcagatttttagaaggagggcatcgaatgggttcttggatattggacacaataagaaatattgagctaaaagtctgaaggaattggcagatatactgttacaggtaaacactttgtagaagaaaataatgaatgagactttcttttgagattttcttagcctcttagttgttcccagttaaagcctcatatttttccttttcatgacaataaaaataataataaaatcagtaataaagtgaatatatgagatgttaacctgttcctttatgacaatgtcctgtttaccaattaacagtgtgtttttgtggtgatgggggcaagacaaatctttaaatggtggaaagcaaagaaagaaattataaaacatgattagttgtattatacgttgtttttggttgttggaaaaactatacatttattgagagaatcattaggaagctgaacatcagctatattgctggagtgatactgtttcagtggtttcttgacctttttgttgttgttgttgttgttgttaaacacagaccaactacggttgaaaacgtaaaaaggattgatggtgtttctgaaggcaaagctgccatgttggcccctctgttggaagtcatcaaacatttctgccaaacaaatagtgttcaggtaaaatactgtggtttgcaggagctcttagagaataagcattttttgtaaccatttcaaaagtaccctccagaagcaacatttgctcactttatttgcatttccatactggacacttagaaaatgaattaaaattgtttttacagtcaatctgttgtaaaaacatgtcagttatctacttttaaagatgatactaaaaagtagttgtccaggctgctgatgtctttctatttcattgggaggttttgtttttaaattggaaacattattttaggttgataaattataattttacattcaaatgtggtagttggaatttaaagctggaaagttatccttgctatgagttggtcaggagctcagccactttcttttggtttagcatcttctctaatctccctccccttccagtaatgctgtcttttgatagtaagtggatttcatattattctcttcagttttaatagtgtttccttcatatccttttattattgcttgttctgccctaagtgaccatttccagaaatgtcatttaggattttctctaaactccacgtagcagactctataatgcatactctgcagaaggtgaggcagtgggaggtagaggggagactactagactaggagtcacggaatcaggactttagttcttccttacagttgttcacctggtgaacctgcacatgtcctttaatttccttgggtctccatttcctcagctatacaatggaaatgacacttcctcccccacatccaggaaacaacagatgacattagaaaatagaagacatgggataagtataaaatgttgaaagagttaaacacattcaaggcaatattaagggattattttttacttccaagaagctcctggaagctttgggcaggcacagttggatcctactttagaaaaatctttctctaactataagtagaaaacccttctgctttttgaatgtagcatttccctcttttgatatagagtatctttggcaactttgaattttctttttcatactcttatataagacatcatgtgaaaattcttatttcttactgagtttttggaaatgaaattataatgtcttaatagtttgagaaagaatatcatacctaccagcggtaattgagtaagttccctctctttggacacttgaaagtagtatcttctttcatgaattagtgatattatttaataatgaatgagtgatctctcctaactccccttcagaagaggaaaatgaagtaggggaaaaggtaaattccccaagggataggtatgaaacctttatgaaccttctggatagagaagatgactgctgatttctgtgattagaaattatacttgggttattctgcaaattgaaatgaattatttaaaaaaaaacaactttaatgtttattaagcaagttttgttattcatgagtttcattagccttttattttttttttaaattttgaagtaaaatttcttgctgtcacaatacacattaaaaattacaaatatgacacatattaaacacattaagatggccgaataggaaaaatatgctaaaatatttttatataaatacattttttgagaattttgagaatttctggaacaaagtaatgatataatccataaatgtacaattaaagagtttaaggatatccaaaatacttggcaaagtaatctgaaataatactcttaggaaggtagggcaagaatgtgattctagtaagcaaaaatgtaatcaaatcgtattctagtcccagctactcgggaggctgaggcaggagaatggcgtgaacctgggaggcggagcttggagtaagccgagatcgtgccactgcactccagcctgggcgacagagcgagactccatctcaaaaaaaaaaaaagactatatgaacttgtatggcataaatatgtacaaatattatttattttaaaaaaattcaggggtagggacagggtagttagaaaatatctaaggatgttcatgaaataatactggctatgaatgacagttgatgaaaccgggtggtgcccatcttattccctcgactcgtgtatatgtttgatatatcccacaataaaccttaaaaaaaaaaagatgagtggtcaattataggaagatataaatagaaaaggcaataaggacaaaagttggcaaagcttacctaagcactcttcagataaaaagacatttttgctaactagatttgaatattatagtttaattgtcaaggaaaatgcctcaacttaatctttgttaagagactacttaaggcactatcagaagttccctcatggcaaggtgcaatccctcatgcctgtaatcccagcactttgggaggccaaggcaggcaggttacctgaggccaggagttagaaaacaacctgggaaacatagtgagacccgacctctacaaaaacaatttcttaaaattagccaggcatggtggtgctagcctgtaatcccagctatttaggatgcttaggcaggaggattgcttgaacccggggatttgaggctgcagtgagccatcattgtgccacaatactccagcctgagtgatagaaaaaaaaaaaaaaagtgtctttgttatattccaaacttgttctcaactttcaggtgagctggcttcctgtataactcttgtataggacagaacatactggttggggcaagtgaaactgtctagttgtatgcctcataaattaatgaatttcctttctaatatatacactgatatttatacacacatacacataaaaccaagctcaatagatgggtagtgcagctctattccccaaaacccaactaccctgtaacaagacacattagacttttgagattgcaaggatgaggactgaaatgctggcctagaccatggtgttgccatagtggggtgaccagtctgaatagccaacaatgcttcctcagtaaatacccattttgtcttggtgggatttctacaaattgcaaaatgcagctattatgaagctgtaaaagagaaacagaaacatgtaacacctgggactgttttattaggcccaccgtatgctcagaacatgaaatctccactgctagggttatttgattgaaattatcttttgtgttgatgtgagagtttagctctgagattcttccacatgtaaaatgtaatcccccaaagtatttggcaagcacattttattgccttgggtcagataattgaaacattaggcatcatatatatagcatgtaaaaagtaaaacagaaacatttatgtttctcaccaagcagtaaattagtactcaactaataaatttcttaaactccctaataacagaatatggaaacaaaaaataaatctttccaaaagaagagctcatggacacatttcctcatatatgtatacataatatagtagaacacatgataaataacctataaaaatgataccaatatcattcatcaagagacgaggctcttctttaaattattaatttcatctgttacaggttttattatgactgtagtatgctgttttcatctaccttttatgtgtagttaaaaaaatagttttctatctctttacctttatttcagcctttaaaaagattccattattttttcattaatcttgtttttcagtttttcccattttttcttttaaacatttcttaaggaaccatatttaagattttatagaatacttagatttctagttgggatgtatcatttaaaattagatatgtagagagagtgttatgatatatttccttacgatatattagtggttatagtacctaaatttgaatagtgattctgttcattcattcattcattcattcaatattcacttccaggagattggggacttatttaaagacagagtagttcacattatagttcctttttttagtccttcttattcgttaaagaaaagactaggaaatgtttgttattacaaatattttattaaaattttgtgtgctctagcattattttaccttttaaaatcaatatgttaaaaatccaacttctttttgagctccccataaaaagggaattatttgttgcttatgggtttaacttgtgttatttttttcttaatggctaattatcatacatatattctattattgtattgatattactgatcatttgtgctacattaaaaattctgtagacagacctcttttcaagtacaaaacctcaagaagaacagaagacgagtctggtagcaaaaaataaaatatgcacactttcacagtctatggccatcacatactctttattccaagaaaagaagatgcctttggtaagtgtgactttcatgttacagggaatttttttagtttacttaaacttgtgttttatcagctttttagtattaaagttctgacttgggatcaatttcctccaaccctacaataaatctcagtttatctttaattttaaaagagaatgttgttttctttttctgttaagcctccctgttaagtaatagcagcaagtttagtttggccatgaatatcttctagagattgtatcggggtactgataaacacatttatagctcagggatactgcatcagccatattttaaaatgggactaacagtttaaaaactataaatattcacagtgttaagaaacaatctcaagatgcattaagaaaaaggaaggtgcaaaacagaaaaacaaacgtaaacgtgtgtgcatatgcatgcttatatagtcacatattcttgtatgtgtacaaaaaatacacactggatctctgcaagcatagccaagcaactggaaatatgtttttaaaaacttgcttttcattctatctcttctagtactgttttgatgctctttgaaaacaatctaattgctgtaacaaatgaccatacgtaggccgggtgtggtggctcatgcctgtaatcccagcacttcgggaggctgaggcaggcagatcatttgaggccagggatttgagaccagttggacaacatagggagaccctgtctttactaaaaatacaaaaattagctgggcgtagtgacgcatgcctgtaatcccagatacttgggaggcggagacatgggacttgcatgaacccaggaggcagaggttgcagtgagctgagattgcgacactgcattccaacctgggcgaccgagcaagacgcggtctccaaaaaaaaaaaaaaaaaagaccatatgtaatgtttcttcattgttctaagataaatctttaaggctgttgaggttttttgtatacaaaatggagagtaagttttaatgggatgggacaaaatgaggcttacagttgagtttaatttgagttcacatcctgttgacattaagttgatttggaacaagtgatatggtccaatgcctgcttttctattgtctgtggttccatccactagtgcctgtgttacacacctcttgttcaggttttatcatttaaaataaataagaataaacagtccatagcttatcttacttactgaataaatgctctaatttgacagtcatgtttcttaaagttccttacaaaggccattgcccaagaaaccaaataattccattatactatttttgaaatagaacacataataaatgggaattttaagttcagtttcttatgtaaacaataacttctatgtacatgttaaatatgcctgtatatacctaatttgaccatgtatgtatagtagaaatgaaaacagttactaagaaaatttgttattggctccaaattttctgaattaagtgtattctaatgctcagccataatatggggtttcatgtgttagtttatgtattcatggttaaaaatgtgaagactgttatatcttcatttgtgtcttttggtattatttggttgtattttattgtgtgatatggtggtataattatccttacctcccaggagtttgagagggtcttgccagttaaccgcagaattaaacatgcctaggactaattaatcaggagcaatactacaattaattggaggtaatttgaaacctggtttcaaataaccctgatattatgcacacatggtgcacacttttctagtagacatttaatgaaagtaatttaaaacctacctttgaaggatgaaaaacattgccttaaatgctctattctgtgaaagtatcaacatttatgcaaatacagtctaaattcagactttgaaaatgtattgaaagagaggatcatgaaataagttagagctgagtgacaaagctttctgagtgtttaaaagaatgttttacctaataaatatctgaaatgtatttggagccacatttgtttaaagaactgtataaatatgtagcactgttcatgtgaagttcaatagtaggaaaatgctgacagcccttgtggaactgtggttattattattttatgaatagagccaatttcaaacacctattagagtcttctcaggaacattttatagaatgcatctggagccttatgttatctctaagcattttaggatttgtcttcttggaaattcatgtaaccaaaccaccatgtgttatttcaagtgtatatagtattgggttacagtttactatgttttcagaaggttgtgacaactattagacttacagagaatgacttctctgccactaacggctttctaaagtgaatagagaggggcgaggattgaattcttcggtaaagctgggtgattttgttttattcaatacagtataataagtataaaaagtagaacctatagagagctataatgggggtagttttaaagaaattctgaaaatgaaaaacttaagtaaaggtttagttcattgtttatttcacactgagcatttactacctgaatgttttggacattttatttccatgactggagtggacacttttacaactcactgggttctttgctgatctttctctagaagagcatagctgagagcaggattctgcctctcatgacaattggcatgcacttatcccaagcggtgaaagctggctgcccccttgatttggagcgagcaggcctgactccagaggttcagaagattattgctgatgttatccgaaaccctcccgtcaactcaggtgagaggcatggcctagctctgcacccttaatgacttgatgaagtaaacaagcaatccactatatttttcactgttaacagcattaatcctttatgctattatgaaaaccttacttttgtgattctttttcttgttttaggaaaacaatctttcttcccattatcactcagaggaaagtatactgagaaatttttttgttttgttttgttttttgagacagagtcttgctctcttgtctaggctggagtgcagtggcgtgatcttggctcgctgcaacctctatctcccaggttcaagtgattctcttgcctcagcttcctgagtagctgggactacaggcgtgtgccaccatgcccagctattttttgtattttttgatagagacagggttttccatgttggctaggcaggtctcgaactcctgacctctgatgatccgcccacctcagcctcccaaagtgctgcgattacaggtgtgagccatggcacctggccaatacactgagaaatttttattttccttttcagcttaaggttacaacttccccaccatccaaaacgtgcactttcattttttttctaatttctatctcatcacttgcaaaaaccatatttttctccacattcattcccagtagcttcctgactcctagttcttccctaaatccttctgagtccttgtcattggtttcgcttgagtagcctttctaatcaacacagtcattggtatcagttactgtgacatggaagggacagaccaagttctgtgggccgctacgtagaaggatttcctgtcactttgctgcagaacctcagctcgcggagagcaagcccctttgcttgccctgtagaaatattttaaattattatcctttttttttttaacagaagtaaataggagatacgttagaggattttctctcctagatgtgtaaatacaaacttggggtcttataactcaataaatctgataaatttcttttgactgttaggatagagcagtggccataccaatagcctcatctccaaagctgcagtgaagatactttttactaccttaaagtctttcccatttgtgaacaacttgtgaacaattccccccaagaatttggaagatcactctctgaaagcacagtcaatactgtacttaaatggatctgagcaaaaataagtcacttagaagacaggattatttctagacttgagtgtgacttgactgaaggtctaaagaacaaacagctccttcacttccattgatcacggtggaagcacagggaaaggacagacacggaggcaagttggagtagtgctcatctaagttccagggatgcgggggagtggccaggggacttcaggtatagtaaataaataacctatttataagttatgtcaatgtcatgtttgaaatagaaaaccaaatactgcatgttcttacttacaagcaggagctaaagttggtgcatatggatataaaaatgagaacaggccgggcgtggtggcttgtgtctgtaatcccagcactttgggagacctagatggaaggattgcttgagctcaggagttcaagaccagcctgagcaacatagtgtgacccccatctctacaaaaaataagaaaattagccagacgtggtggcatatacctatagtctcagctacttgggagtctgagtcaggaggagtgcttgagctcaggagtttggggttataataagctgtgatcatgccactgtgctccagcctgagtgacacccagagtgagaacctgtctcaaaaggagaaaaaaaaaaaagtaacagtagacgctgggaactactgaggggagggaaggaacaatggttgaaaaggtgggaagggacagtggttgaaaaactacgtgttgggtactatgctcactatctgggtgatgggatcaattgtacctcaaacctcagcatcctgcaatatactaatgttacaaacctgcccatgtactacctgaatctaaagtaaaagttataatttaaaaaaattataataaaatcagaaaataaaggtctgagatggaaaattaaaagaccaaagccacccataagcacaataaatccctccccccaaaaaattatatctattaaaaaaaggtgttgcgccaggcactgtggctcatgcctataatcctagcactttgggaggccaagacgggcagatgacttgacttgaggtcaggagttcaagaccagcctggccaacatggtgaaaccctgtctctactgaaaatacaaaaattagccagcagtggtggcatgcgcctgtaatcccagctactcaggagactgaggcaggagaatcgcttgaactggggaggcggaggttgcagtgagccgagatcatgccactgcacttcagcctgggtgacagagtgagactctgtctcaaaaaaaaaaaaaaaaaaagaccttgtaccctgacaagttttagtttgtgcaggaatgacacaatctagaatgactcaagattggaaaaatctttaaatgttaattacacaataagggtaaaaggagaaaaattacctaatgtcatctgagcaacaagaagaagaaatgaaaggcattaaaaattgggaaaaatttatatttgacagtatcttaacaacgaattctgcttctatatcacttcctagctttctgatgataacttcccgtgcagatctgtatgtaaggaatggacgtagtagtcatgctaatctgagtatttatctgtgtgatacttacgaattaacgatgtaagttaataagttagcatttcgtgaacctggttaataccatttgctaaggttaaattagccaaatcctgaagtaagctgtaaaacatccaaggtagggtagagaggcatcttatgagaaagctggccaactctcctggtcaccttctaatcttcctaacttcagaaatcaaggcagagagaggaaaatagtaattactttgtaggattagatttatggttgtcgaaacctttgtttctccagtgcagaatgagatagcgttttagggaaagccaaagactcagatgtcttcttcatgctcatcgtgtggaatttttcttcctttagaaatgtattgtctctcagggcttaaagcaatttgcatctttcgatgagacattgagtaataggcaatattctctgaaataatttgtgcaggctgggcacagtggctcacacctgtaatcccagcactttgggaggccgaggcgggcaggtcactgaggtcaggtgttggagacgagcctgaccaacatggtgaaaccccgtctctactaaaaataccaaaattagctgggcttggtggcacacacctgtaatcccagctacttgggaggctgaggcaggagaattgcttgaacccccatgggaggtggaggttgtggtgagccaagattgtgtcattgtactacagtctggacaacagagtgagactctgtctcaaaaaaaaaaaaatagaatttgtgcagttccccccacccccttttttttttctgttggcatttttgctatcatttagctgccttctttatatcctgaaacttacaggtggtgttggtctagtcagtaagagcaaaggctttgggaatagatagatctgtatttagaccttggctctagcatctcattgttatgtgacctccatcaagtgacctaatttccctaatattcaatttcctcatctctaagacagggagttaatattgcctctcttatagaattgtgagaaatatagtcatgtgtcgcttgatgatggggatgaattctgagaaatgtgttgttgggcgatttcattttgtgggaacctcacagggtggacttaaacaaacctagatggtatggcctactacacacctaggctgtacggtatagctcctgtcttcaaacctgtacagcatgtgactttactgaacactgtaggcaattataacacagtggtatttgtatatataaacatagtgaaacatagaaaaggcccagtagaaatacagtgtaaaagattttttaaaaaagctgggcatggtggctcacgcctgtaatcccagcactttgggaggccgaggcaggcagatcacttgaggtcaggagttcaagaccagcctggccaacatgatgaaactccgtttctactaaaagtacaaaaattagctgggcgtggtgttgggtgcctgtaatcccagctactcaggaggctgaggcaggagaattgcttgaacccaggaggtggaggttgcagtgagtcaagattgtgccactgcacttcagcctgggagacagagcgagactctgtctcaaaaaaaaaaaaaaaaaaaagagataaaaaggtacatctgtacagggcacttaccacgaatggagcttgcaccctgggagttgctctgggtaagtcagtgagtgagcggtgagtgaatgtgaagacctaggactgtgcactgctgtagactttataaaccctgtgcacttaggccacactcacccctgtgatacgagtctacctactgtataacgtacctgcatatgtacccttgaaactaaaataaaagttaaaaaatttatcttcttttgccaataataaattaaccttagcttactgtaatgattcttctttatgaattaaaatctttttactcttttgtaataacacttggcttaaaacacaaacatattgtacagctatacaaatatattttctttatatccttcttctctaagattttttctgtttttgattttgttaaatttgtttttactttttacattttttttgttaaaaaccaagacaaaaacccacacatcagcctaggcctacatgggctcaggatcatcagtctcactatcttccacctccacatcttgtcccaccaggtcttcaggggcagtcatatgcatggggctgtcatctcctgtgataacaatgccttcttctggacacctccagaagggcctgcgtgttttacagtgaacttctaaaaaataataaaatgtatagtatagcaaacacataaacatagtaacatagtcatttattatcattttcaagtattatatactgtacataattgtacatgctagacttttacacagctggcagcaaggtgagtttgtttacaccattaccaccacaaacacatgggtgatgctttgcattgtgatgttacgatggcatgatgtcactaggtggtaggaacttttcagctccatgataatctaatggatacttgttcctgttggctgcccgtcgttgactgcaacatcattatgtggtgcatgactgtaaattagatactgttcagaaagctttggcacactggtaatagcaaatggtggtggcaaatatgatgatgatgatgatgatgattgaagacatagatggtaaaattttatggtgtcttaaaagtaccctctaaatatgattatttttatagtctgtccttttgaataggcacttaagaatgtatgaacttaataagtatataagaaagaatgttccccaaaatatatcttacagaggcatacaatttaagaattcaaacaggttgtaatggggtgtgtgtgtgtgtgcacacgcgcacgcatgcgtgctcattcacactaaagaattcttgggcatatgttcctgaatgtcctaaatggacattctaacatcacttcattatgggcagagggaaatggtaaagaaaaatttcatattatattattcagccacatattgacagcatctgttttatttgcctatggtaaagaattgaagcactgttaatttgctttttaaatcatgtaggcacaaagttatcgaactttagatttagaaatgaaactggaaatcattacactttccctttcctatccccaccctgttttggagagaaagagtgtgaggcttagagagttataaaactgttttaataccatgtctaagattaataactgaacaagtttctctttttactcgtgttaaagttgtactgccaattaacttaaaagaaagaaatatgcaatttctaatcctgatataggatatgggtatataaactctaacttgatgagtgaaacaaattaacttatttataatcagtttcatatctttatttattgagtgtctttaaataccccttacctttaaagtaagaaatattaaaatcaagcagaatataataatgaaaaattcttaagatatacttactaaaaacttatccttcggttaatacactgtatgtaggttgtacatacaatatgaaaaagtatatttttgtagcctacttttaaatccagaatagaggaggttaagaaggttgtgataaccatgagctctttttttttttttttgggacaaggtcttactctgtttcccaggctggagtgccgtggcacaatcatagcttactgcagccttgaactcttgggctcaagcaagccttccacttcagccttccaagtagctgggaccacacctggctaatttttaagtatttttgtagagatgagttctcactacattgcccaggctagtcttgaacccctagccttaagcgatcctcccacctcagcctgcctaagtgctgggattacaggtgtgagccactgagcccagccctcttttatttcttttgatagtacactcataatcattaaactatcatttctggatgtgagattgtgcttttggattcttattttttctttataaaatactttttgttctcttactggagaaaacattgttggattataaatgatataacaaggaatgaggatatacatactataataacgattcagatatgttattttcatattttatttaactgtagccatgccacaataatttagagttttaaagaacaagtttgattgaaatctaaactttgtacaatcctgaattgagaagtttcctgtattttattatgacacaatatttacctaaaaatagggtaattatgaattgagaaaacatagctattaatttcatactcttatttgttaagtagattttgtctggaaaactgttcatatttaaaggagctttgtacctttgtattctttttgtttttccttgtttatataattttaaactctgtttatggatttgggattctaactatgctaaataataaattaaggcattgaatgaagtacctagacagtattttgattaattttattcccccattcttaatgtgcatgtaactggaaaattaagagtggcttccaagggatctactacaaaagtaaggttaatatgatctcttttaaaacactgaaggcgtgtagccagtgttgtcattaattctgcagtagatattttcagcacttatttacatgggaagttagagcagagtaagatgcacctgtaaagctaaatgccacttatttgcatatatataaaacgcaggatgaatttaccatagaaatataaagggtacttatagaaatgtattagaaaaatatatgaatttttaacttatatctagaagttaactttatacatttaactttaaatcattaatagtggtttaacaccataagcggatgtttatgcatcatcattttatgaacaaaagacattctaattttagaaataaagtgattcaaaagagaataaaatatcttactttttcttttaaaattaatttgtttagcgcattacatgataatagctcaagcttgtgtgatttttccctaaaaaattggtttataaatattacatttatagtatgaagaaattaatcatacatagtttatttatctaatttctaaatacccatggaagaaaatgaatttaatggaatgtagttgtgtattacttggtttcgagtgtgggaaaatttatatggtctttctaaaacagcactgtcagtagaaatacaatgtgagctacatatgcaattttaaattttctagtagccacattttaaaaagtaaatggatgcaatttattttgataatataatttaattagtctactatatttaaaattttatcatttcaacatgtaatcaatatgaaaattattaatgagatattttacatacttttttctgtaataagcctttgtaatcaggtatgtactttatatatacaacaaatcttctgatgctaaattttaactggaaatacttgatctgtgtttagcttttgtaaaatttactgttgaacaacgtggactaatgtgcctaagtggttccaaacatattttaaaatttgaagacaaataaaagggaactcaaagtaaattgggatacatacatacaacagaatactgagccattaaaaaatgatgaaatagtaaaattgggggaattttgatgatactaggatgatataatgaccaagagacaaatacaattttagtttggttgagagatgtgatcatcacgttgctgattttactatgtatagaggttatcttttcctttctaagattttgaaactttaattagttaacccacttacctagtttctattagctgtgtaactttctcttcctgttttttgttttgttttgttttgttttttgctttttaactgcagtattttgaggagtcttggagtagcaagctaatctttggaagaaaggaaaatataaacctgaaaactaacaatttaaagaacgtcttttcaggttgtcatttgaaaaatacttgatttctgatcactgatttgaattgagtgtcaaatatttgatatgttttgtaaattaggtgaagatgagtgagtaggttctaaactgcttgggtttaccgcactctggagcattgcagaagaatgtgatgttggaaggaagtgctgaaacataattattggcttgcctataggagggtgctacataattttagaaggtgtcaagaaagtgacacagtctgaattagttctgttgagttgcaaaaaatgtaaagtttcttgattctgaaaataagaaatatgttcccagaaatctcatctagttaatgtgcttttaaaatcattgatgtctcttgttattacaataatagccattgaaagaatcttttttattagaatgttatttacaggtacgattagcttctatttaaataaattatttttatacttgatcttaggcaaaaggccaacaagtgatcagaataaattattttaagagaaaactaattataattgatatttggaattggaagcacaatttcctttagaacaattccacgaatggttgttttgattctcaaggcagcccacaaaagacagtttgaaacacaatttatgcagtgtcaatagtactgacctgactttggatcttggaggcaggggcttcaggtgatacccgagtggagtttttactccatttccattccgtaaggctataggcatttgaaagaggaaacttttctttggcaaccttccaccttcctttctacagaatatttcagtatttctagctcataggttttctaaaatattctctgtaatttattttgaaatggagtttttttatcgtttacagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatactgaggtattaattatatatagaattttcataaagtgtcagtttgttcaatttgcatatcctagtactagaatgctgtatttttttgaactgttatgaattctgatatgattactttctctatgtgctacatttcctttgcttttcataaatatgatctgagaaaagtgattaaaaaaaagacagtaaaagggaggtttagtccatctgtttagcttattatgtagaatgtcagcttaaattttacctgtacctcatattgaccgtatagcctggaaaatctttcggaggtatagttaatggatttaagcatatggcagtttatgtagttaatgaaagtgaaaacaaattgtattataaatacctcccaaactggtttattatcattctatcattcttcatgctctgttagtatgatattgaatatctgaggtaccaggattattgttgcttgtggctctgagcatttcgtagtgcttttgcatgatgagagaaagattacaaatttagtattatgttagatggtacgttttattaaaatcaaatgcttcaaaaataattgctctgtgtatggcatgagataaatagcaatcagatatattgtttaataatatgactctattaaatgatggcataaatttgaaaatttgaccttcggtatcttccgggtctaaaattatatgactccattataaatattttggaaatgattaactaaaaaattgtttcaattcttagttggtaaattcaatgtggtagtaggtggtggtgattattttgtattagagaattaggaattacacttagttctaaggtaatctttataggatgtccagcaattaaacccctacttttttgaattgcttaaaaataagggaactgatctttttaaattctgtacttgagttacgtctgtatatatagtcatgtcctagataatctaatggaacttaattagttggaaatctttatattgtttataactgaactagctataagaggaacattaaagaaaacatattttgagtggaggtaatgaaatttagcttctaatgctcagccttttatttctgtaatctataccagatacctaagaccctcttattgtttcccagcttcaacctgtcagtatagaaaacggtgtaacttactattttttctcaatattgaagcacatttgtagtgaaatattattttaactatatattgccatttttgctttttccctatttcagtaacatttttcgctatttcagtaacattacatgtcaacaagagaatggtgggtattttggggggggttgggtgggaagaaattttactaagcttgctagattctaaaaggtataccttatttggccccttttccccatttaggggaacaagggtgttggggctgggaagtagataagaggtgagtaagtcatccaaagcatatgtcttcattagcctccctgtatgaaaagctgatttctgtagagtgttggaggcctactttcagaatctgtcatatgttaacattcatcttctctactgacctgatttatatcccttagtctatttcattttataattatgacaaaggataaagtcattagaacaaattctttttattagttgacgtattgttgtgtttatatctcttgtgtttgttattaagatggaagctcaatcatgtccttgtttaacagaaaggtgatgtcttggcattgataattctgattcaatatccataggtacatggtggattctttaaatatttagtattcttttatttctggaaagttttcttaaatgatagtttttttaaaatttcatttctataaagttttcttaaatcatactttttagtgttttattccattacttcatatttcttcttcaggaactcctgctatacatgtatgttggatcttcattacccagcttcaatatttttcacttttcatgcattctttttatttcttcatttctctttaaatttttttcttccttttcaccttctatttctcttttaacataattgtatttatttctgtattccacatagcttagtattcacttattttaaaattattttaaaacgttttttagatttaaaaattctttttttatttatatatacatattttatttttaccaaaggagcaacactattaactgaagacttctataatttttttcttttatttctgattctttcttcggttttccccctcagttttgaacttttctaattttgatttgtgatgtccttttgtattttagataattttcctaatgttttccagctcatttggaaaggctacagttttattctgtacctaagcaagtctttctggtgtcaaagatttgaccttgatacttttcttttgctcattttcgtatgagattagttttcctgtactttcaaaagaaggcgtggttcaagatggctttcccaatttcacatctgtctctaatgtttttgtgtaatgtctaaaatatggaaacttggtttatgagatctactctgccatttttatctgggctttctcttccttttgtctctgttgtacctgtcctgcttggttttgatttaaccccagtggtttctcctgaatgtggagccttctcctagaaggcagcctcggctagtcccagggttcagagtagccagctgctctcttcacctaagagaccactgtggattccttgtactcacttgctattggcttggacaaaagccctcccattttcagatgctattatcagattaatctctcattaatctgtctttccagtgtatgcctgtgggctatcttggggttctcttgttatcagacacctccctgctggcctctgctttctcccgtacagatgtcagtactgtgcaggtcttaattgctgttggtggtttgcccctacattcttacagttttagtttcccaaggatacctttaaacttggttttattgtaaatgtcgacaatggattttgggttttactatctagttctgtcttaattctggaattcagaaagattaaaagctctgttgttgcagctgctgccacctcttcccagtaccctctcctcctatgtcatttttttcttcttatttttcttgactgtataagagagaatgtatgacatttcctgcttgaccgctgagtttgattataaattaaaatacacaatattttatacaaattgttttgtagaagatttatttacagatgctcattcacaggtaaaattgacttatgaaaatagttttcatgacaaatgtatcaggctcggtaactaaatatatggattgatcttgtttataaatgaaattaaatgtgaatgtaacttacatatttctgtatttgcttacatccgtatgtacacatataatcagcaaatgagttgatgtttcctattcgtaacttaatggtaatagcttggtaacagagttgggagtattaaaaagatgtaaagagccccttaaaattttgttgctgggaattttagtgttctactgatgaaggaaatagacactggaaggtgttgtttctattaggtaacttagatatcatactgaagacttcaaatacttattgttgacactcaaaagacacacttagtgtaagtaagcatttccccgcttttcccaatgaaataagatcattattataattccattataaatgctgatgatcatatttatagaaatatagaagataagacttgaaatgatattcgctaccaattaatgagtttgaagaagaaatcaggatgtgttttgctattttacatttattcttatttaactccaaagaattcagtgatgttatgtactattatttccatttctctgtgaagacgttgaagcttaagtaacacgcataataaggtcatacatttagcaagtggctcaattaaagttcaaacctggttctgcctggtttcaaagtctgtgctactccatggtattaggctacaacatgacttagggtttcttcctctgctctattgctgttcagatgtactcctcttttggcagagtgggagaaaatttttgcaatctatgcatctgacaaaggcccaatatccagaatctacaaggaacctaaacaaatttacaagaaaaaaaaaaaaacattaaaaagtgggcaaaggacttgatcagacacatctcaaaagaagacatttatgtagccaacaaacatatgaagaaaagctcaacatcactgatcattagaaagatgcaaaatgccttttctgtatgccaccttatatccccagtatttattatttctaagtcatagtatcttacagtgtatataagtctcatccgttcttttgattttctcttccctgcttgcaattgggtacctaggaacaaagttgcaatcttagccagttttttctttagcctttgctgatgtgtgaaaagcccttttttctaccctggatttctgtacttaagctggaacagctaagtttttaccttttttaaatataaagtttcagagtcttctgccaaggatcttttgctgttttcctactgttaaatatttcaaagccttttttaaacatagggaatataatcaaacatagcaagcagctgatgaacaatatctagatagtcttcattattgaaatggaataaatggtatttttgtattttaggctaacagacaccttgtaccttagataaggccaaccttctcataaaatccctcagttacttttattaataataaccaaattaactctggattccagggtgtactcatgatggaatgatttctctgtcatgttatcctgaggatctagtactctgagataacataagtgtatgacactttaggcttatgaaacacttagctacttaaattatttaattttttttcatgtgcagatggtattgtacccaaacactacctttgtgtgtgtgtgtgtgtgtgcctgtgtgtgtgtttttgagacagggtcttactctgctcaggctggagtgcagtggcgtgattatagctcactacagccttgacctcctgggctccagtgatcctgccaaagtgttgggattgcaggcgtgagccacctcacccagccttaaattatttttttttcaaggatgtttaacctgagggttagaggctctttggcacgtgagctgctgaaatgtgtgtgaaagtgttgtgcacgtgtatgttcctctttttttctgggaagtggatctgtagtgattcttagatgagtctatgagacaagaaacttttatttttttcatttatttagcgaatgtttgttaagcgtactatgccttggccactctacagggtgctgattggaccagtctgtctacctaccgttgtagatgttagaagctatattcttttcacatgcctaatataactctttgtgtatgtatacatgcccaggcatgttccttcctcagaacattaaattcaccattttggtcaactcaaagcaagtacaccatgggacacagatctgaaataatgtccagatttttacttactgaatgaggtgtgttgagtgtataagactacatgatgagatggcaagtaattgcctgaagaaatgatgtagtgattttgtgtgtcttatatttatttactttttgatccagaaataaattatatagataccactattttgtttggatgggggagaaaggatgggtgtgtattcaggaacttatgttacttttttgcaactaataccccttctcagtagtacaaagatttgatttctttttctttctatttcctacagacttcatctgcagagagaaagagacgattacctgtgtggtttgccaaaggaagtgataccagcaagaaattaatggacaaaacgaaaaggggaggtctttttagttaagctggcaattaccagaacaattatgtttcttgctgtattataagaggatagctatattttatttctgaagagtaaggagtagtattttggcttaaaaatcattctaattacaaagttcactgtttattgaagaactggcatcttaaatcagccttccgcaattcatgtagtttctgggtcttctgggagcctacgtgagtacatcacctaacagaatattaaattagacttcctgtaagattgctttaagaaactgttactgtcctgttttctaatctctttattaaaacagtgtatttggaaaatgttatgtgctctgatttgatatagataacagattagtagttacatggtaattatgtgatataaaatattcatatattatcaaaattctgttttgtaaatgtaagaaagcatagttattttacaaattgtttttactgtcttttgaagaagttcttaaatacgttgttaaatggtattagttgaccagggcagtgaaaatgaaaccgcattttgggtgccattaaatagggaaaaaacatgtaaaaaatgtaaaatggagaccaattgcactaggcaagtgtatattttgtattttatatacaatttctattatttttcaagtaataaaacaatgtttttcatactgaatattatatatatattttttagctttcatttacttaattattttaagtacctttatttttccaggatgtcagaatttgattctaatctctcttatgtagcacatgtgacttaatttaaaacctatactgtgacacagagttgggtaaacgatgattatttaactttaagcagttcaccatccatttcaaagcctttgattggcttttttgtaaataaaaataacttgttaagaaacaaatatatctgtcatagaagaactagaaaatccagggaagtgagaaaaatgaaaataaaaatcattcatagttttactagtagctaatcacagtcaacctcttttgtgtatcccaccagacttttttatattcatttgtttttaggtaaaatataaaagtctcgtatattcccatttttctgcattgcattaccagaaggtagtggcgcctattaaatatgtgatatgttgttgtccagccatggcttctgcatttgcatgcttttgtgtgtgcatctgcaataccctgtgaatatcctgtgtgatggagtggcaagtacgcacagacacgtctgctgcatgcctaggtacgaggctgtctccaggagaagcacttgtttgattatttgagttgccaattgaatttgctgctttttttcatggcttgccattttcactgaaaagaatgactaatgaaaaacgatgattggttattagatttggatgtttggcagacattttctcaaaattgaactaagttggcctcttcacggaaaacaactggtatttgttgtgccaatgataaaattggagatttctagcaaaatgtataattttggaaaagttgtgttcctccactggaagcttgacagctttccttaacataaagacttctctttctcttcgctttcactactactactactaattcttcttctgattcttcttcttctccttcttccttcttccttccttcctcctcctcctccttcttcttcctcttcctcttcttctttctctctttccttccttcccttccctttcccttccttccttccttccttcctgccgtccgaccgcctgccttccttccttccttcctccctccctccctccctccctcctttctttttctttctctttctttctttctttctctctctctctctctttctttctttttctttctctttttctttctttcaagcagtcctcccgcctcagtcccccaaaatagtgggattataggtgtgagccaccatgcacagccttacataaagccttttctaatgagatggatagtaattaacaaatgtgagtttttgatattatataaagattttttctgtgtttcgaagatccgtataactcagtgaatcagtatgttctggatgactaatatgtgatgttaagaaatcatgactgaggccgggcgcggtggctcacgcctgtaatcccagcactttgggaggccgaggcgggcggatcacgagatcaggagatcgagaccaccctggccaacatggtgaaaccccgtctctactaaaaatacaaaaattagctgggtgtgttggtgcgtgcctataatcccagctactcgggaggctgaggcaggagaatcgcttgaactcaggaggcggagattgcagtgagctgagactgcgccactgcaccccagcctggcgacagagcaagactccgtctcaaaaataaaaaaagaaatcatgactgggtaaaagatctgttcagagtacaagatggaccaatggatttgatatatttgaatataacagagtatgaaaaagtttattgatatagtttcagattacacactgcaactaatctttaagaaactattacttgtccactttttggtaaaatttcagagaacaatgtccaccattatctgaacaggctattaaaatactcttctcttttccaactacgtgcctgtgcaaagtcagatttttttcatatacttcagccaaaacagcatatcaaaatggatt

SEQ ID NO: 30 - DNA, 9173 bp, Human
tgagccactgagcctggccccttggttattctttagattgataatgtaacagacagtgtaaatacatctacaaattcagaaggttaagaaagggtatgcaaggaaaaccggtctgtccctcagtcacatttttcaccaccacccacaagaaggcattgctatcaatttatgtattcctcccaaaacattcaataaatgtagaatcagttgcatacattcatcttgcttttattgtacacaaacagtaccacactctgtactttctcatttgtacttagctaggagattttacttcagttgaatcactttacttttagagatttttctctataagaaaatcagagttgctctttcttgttgatagctgtctatcttccagtggaaggatgccccaggatttatgtatccagcacctagagatgggcatttaggttacttgcagtatggcttccagatagggattggttcgcgtattttttcacataagtttaaaatgatctctcacgtctgtctcatcatctgtaggataaacagctgagggtggcattgttagcacagaccattctacctccagcttcagaatttcagggtagttattattttcacctgcccttacaccttccctgaagggagcagcagggatcatttccttgaatgtaagaatgactgtcacttgaggtgattcagcaatgctctactgttttagagtgttttagccagattacagagaaaggcatttacttagggcttgcttacagtaaacaggactgtatgggcatcagaaatgtgaattcttgttcaggatccaccgttatagcctctgtgactttgacctggcaatagccttccttctctggcctcagtgttctcctctataaagcaaggggctggacaagccatctccagtttcccagtttggcaacaccactcctaaaggatctgaagggacaacaggaggcccaggcctggaggtagggtagccctgagcctgtgcctagaatgggaggcaaagatggtggcaggtgggtgggaaaatgtggggtttgggggtcacaggagagaccaaggggcaggcctggagcatggcacgctccctgatcacagctctccactggaaggccatggagggagtgatggggagagcctgcaactcctggagataagcctgattctgactttctttgaaggatttttttctttcgacttctttcctgtgaaagagaatatccgagaaatgagaattttaactaaagagaaaacctttgcatttgctactgataaatatctggcctatgcgggaaagtcatgggtgccctgggattctggctccactgctaacaagaccttgttagaccttcttaactgcccctccagagaggagaaaggctcttggaggtagagtgagattggggagcttggcagagccctaggatgaactgtgtttttgttttgttttgttgcaggttggagcctttttcctgcagaaagagaagcaattccgggcttttccacagataacctgctagggctcgcagagacctggattctaaccccatctcgcctttcctcacctggggcattgttttctgcgtttgagaactgctgggtgggctggtgttacccaggatttttaaatttttgcaggagacgctttgcaggagatctctagggcttttttctgtgtcaattaaagagcctggccagctggacctgggctgtctttttgacaaaaacaaacgtcatccccctcccagctgagcacttgttagaactggactttaactgagggcctgaaccccctaacaacgggacaaacagtatgaaatcaaaaccgtttaccctcctcccaccagcggtttgcgtagggccttgggtgcactagcaaaacaaacttattttgaacactcagctcctagcgtgcggcgctgccaatcattaacctcctggtgcaagtggcgcggcctgtgccctttataaggtgcgcgctgtgtccagcgagcatcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcaggtaccacagtcccgcccctgctccagcacctcctgccgcccgcccccgcccggcacctcccgcccccactcccctaactactgggtggggctgcagccgggcaggggcttgtccacaactagagcttgaaaccagagcacgtagttggggaaggagcttgggtcacccagtggagcccgctcattgcacggtcttggcaggacgtgctctgggagaagaaggaagatgttccagggcacacatagcttagtggagactcaaggaggaagctcccacttggccctcgtagcccagagatctttagagacccagacagcaagagtagagggaggcggtggggctgcctccgcagttgggatgccaccctgggtcccccaccagtctccttgccagcacgtgggcagccccagtggctggagcatccgggaaggcctaagaagggaatccctcctgctggcctccccaggaggtgtttggaatgtcctttgtaatatacgtcctggatacagtatgtgcttcccagatgtttacagaacataatgtgagagttgaggctaaaagcttcacttccattcattgccatagaaaaacaatgtttgatgtgtatgttgccccctaagaacatgacaatcaggttctttcctggatttaagcaggcatttgtttgtagcgggaagtggaggaaatgcctctttctctactccagcccctatctcctcatctggactgcttgcacgtcctgtcctgtgccattcttggaggaattaggacttccataccctgatagggtgttagagtgagtgtgtgagagtcagtgacccttccaaggagggaacagggatttcctgcggattctctgcccttcagaggaaatgaaagggagtcgtctcactgatcctcaaggagatggatttccacagggggtcccttataggccagtgtgctgattctgttcatgtacctttggactctatctgcaagatcctcttgccatgggggtggagggggtgttgcagagaagtccattaggacgtgggaaggcaggggccccaaaatagaagagggtagtagtttgggtcaggagagctgcattctagactccacttctagatgaactgtaccatccattcagggatattagtaaaatccccattttaaggatggagaagctgaggtttcgaggctccctactaatgcggttaggaactgaactctaatcctggcttctttagggttgttctcaacctcagcaaatgcatttgttgctctgctcccctgctgctttaaaagcagaaacgtggggcacccttgccaggccctgaaacttactattgtcaggaacagagctggcatgctgttgggacataactcttcctggaaaccattacaaggtcctttacagtgagagtcagtgaaaatcaggttagggaatgtggccatcctcatggcccagcctggttttgagggaaggaagtgatctcctgggggcccgaaaggggcagatgctttgggagggctcatggggtctgcaatgtttcctttccagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggtgaggcccagcaggtgggtggtgggaactctcctgtcagaggatgtagcttgagtcggctgtgacaagcagacctggcccactccttcctggtcctgatgccctggaaagaaatgcttttcccccaaaacctagtggccatttctcagttaaactttgtcaaactgtgaacacatggactttcaggagaggagcccactggatgcaaagaaaatgtagttccggacgataggttacttcatgtctctgagctcctctctaaagggtgtgagaacattgagttacattgttccaaaacttagtacaagggcctaactgctttcacccccattgtatgatttgcctccctttaaaaaagttgtcataaaatagacataaaatgtactgttttaactattttgaagcataggtttctgtggcattaagtaacaataagtaatgcatgttattctgcaaccactaccaatatctaccttcagaattttcatcttcccaaactgaagctcggaactcattaaacatcaactctccattatcttaattatgtctgttttgaattctaccacttgagggcgacagagaatcaaagtcggagtgatttgatttgagaaaataaattacttccacaaacatgcctacccagaaaaagggaggattaaaccattttctcaacattttggaatttcatctgagaataacgataaatggaggaaagttaattcttaaattatccaaatgaatgccttaatcctcacttgatttagtttatgtaaaagaaccttgtagattgcagaggaaagttattcaaaatctagaaatgtcttctgctaaattcttaattaagagttatgcccactcttctaaccagatggcgggtgccaaaagtattcagtaggtggcaggaagagttgggaagagttttgtggtgttggtgaggctcttgccaggggatgtctctgtgcaggtgttgagagagtgattggtgagggagagaatggtgttcttgttctttatctgaacaacttaagacagactaactgcaggtgggaaaaagaggcccagagggagcacatcacatgacacctagtcccaggtccccgtggccagatcgtagggccactcctgcttctacaaaacctcttccatcagtcattgtctaggctgataattcactgtgtcttgttagatatgctaatgtcaagttattctcttaggagccctgccgaatagaactctacagagtcgtagagagtttagccaaggcacaggagacatcaggagaagaaatttccaaattttacctgccaaactgcaacaagaatggattttatcacagcagacaggtaggtggccttgccagtgtgcgtcgtcagggtgaaagggactactgccctacattcctgccaagccacggtcattcatgtcaaagaaggtccactccaaagtagacaccagaagtggttgtattgagccagatccacccctctgggaacctggaacagctaggtgaagaaagcctattgaacaggtcaatatgtcaccaccagaggtggaaaacctgcgctggaccaggggccctggggctaagcctgagctccatcactcagcaagccaatagctatggaagactttcctaggccccctaacgcttggatcttgggttcctcacctatacaagagaggaagggaacaaacttaacttagaaaagcaagtatctatttggacagctcttaacacttttttctccttgaactgtctaataaaacacaacaacatttttgtggcttgccagataataaatgagatcaaacagaccaagatttcatattgaggagtgctttaggtctcagtgaagtacaggttctgtagattttattgggagaaactgaggactaggccctgcttcacaggcaatgaacagtggggcacacacgagacatgttccctctgggttgggctcccctgacatcaggctatgaagcagacagctgtgcacacactgtactgtttaacacacatgggaagtcattattgcacatgccactcggtcactgtctctattttatgatgagaaccaggagggtgtgagatttgcctgcatcatgggcagctggtttcacagccgggactcttggcttggctctgcagtgctcggctgcactgaaaaaagggccagctatggctctactttccctgtcagcttgtcatctgctgctcttgaccttggtcttgtctttgcagtgtgagacatccatggatggagaggcgggactctgctggtgcgtctacccttggaatgggaagaggatccctgggtctccagagatcaggggagaccccaactgccagatatattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaatactgttatctctgtggatgtttatttagtgatattatctttttgaaatccctttgtccttcaccctcaccttccttatgcattttgtgcttttgtgataccaagatggtgttttgggtctgcagagccccttgtcctaactaccctagatcttgccccggctgccccagggtttccacttcccagtggcattgggaccttcctcctctgcctggccaggctgggcattcctgtgtcccacctctccattagtccccatcctccccagggtcctcagcctcttcctcttggtttggtttgtcccttccgttcaacttataaataggaacagggtttctttcctcttaaacacaagacagaagtgcttccttggttttgctccctagcctttcccttgcttgccctcccttcctgctagcctccttcttccacagggctcccagcatccttttgtcacttctgtttccatgactgagccctgattgcatctctcttctctgctcctcagagctcttcttccttaacactgtgccctgcttggtgtgcccaacgctgcccctcctaactcttgctcaccctgttgactgcttctttcctcccctccacatctttcctagcaccttgcccatcccaggggattccatctcggtctgctggctgcctccagccctgtctcttggactccccctgctctatgtcggggtgaaagcccacacttctccttgcctcaggccacctcttggaggcttggcatccatggctgcttctctcatctgtggggctggtggcctccctgacattctggtttttcctggagactctagctccctatcttgggtcccccctttaaccctccaaccccatagctgccaggctgccatcctctctgccatgaccctagggctggtgtgtaaactcagcactcagactcatcaagaggagcagccagaccgatgtgggacagggacagactgatagctgcagcccagggccaggaggtgtgttcatttgctcaagcaatgaaaccacatctggcacagcagctgcaattggagtcaccactccattaagcttataataattcactgttattgtctaagatccaactgtcttctgcacaggccaaatagcagagttcagtggggatgtggtgagaatcaccactcctgcatctttcaagtccttgatggtggcactaatttctgccatctctctgggattgcaatatggcttctgaactgatcaatgacagttcagagccagtgccctgtagttcctgaaaggtctgattacttcctttccctcaatccacaattgccccagtgaaagcctctaggtccctttggagaacactggtagaaatattttcaacagtgtactggggccctttctcaagggggcccagcccctccttcattcaaggggttctgggtctgtaaactggcttaagtctgagaattgattgaggtgccaagactctgtttttgtgattcaaattagatttttgttcacttgtccttgaactttcctgcttatacaagtcaataacaatttagtaggcttcctatcagtttcacttctaggaatgtcatgatcaagtagccaacgtcatagatccacaggagtctgactattctgagtgctgccttggctctgctgtccattagagtagctgtacctaccttgcctttgttggttgagtgcctccacttggtccctgccacccttggactctcattatttccattgcatttatgtttcccagttcagcagctgcagttcccactgtacggtctggcctacagagaagagcaatgccagagctcttctagtatgctgaggctcccctcataaatgtattccttatggtcaaggtgcaagataatgccctttggacctgcccatggtgggtaagaaagtcttaaatgacaaattccctctaacattctagtgtccctaagcctttgagttcatttctactgtaaatcaatgcagatctt

SEQ ID NO: 31 - DNA, 312957 bp, Human
  misc_feature (1)...(312957): n = A,T,C or G
ctggtccgggaggccacgccagcgcgacccagccgagtcggcccccagcccgggcccccacatttcctcccccggagggagggaggcgactctccgcgggctgccctccccagcgcccgccgcgccctctggcggccgccgcggggacgcgcccggggcacgcggcgctgcctgtctgggccccccttccggggcgcggggcccgcgaggggcggcggggtcctctctcctcgagccactctgggccgagccacacgggccgcgcccttccccctccgctccccctgagcccccaaactccgggctccacggtcgcaacgccgcgggcaccccagcctggcgtgaaagtgcccggcgtagtagcctgggggggggggtcccctttctcccaggtgcgccccttccgccacgttcgggctttccagtacgcagcgaaaaaaatgccgcatgcacgcatttatttattttgcaacagctgcaagaaacaatgaagcttttcaagaaccggggaaacgcgctttccagccgcgctgttgttgttttcaatgaacctctcccagccccgcactccccgcccacccctcccctctcctgcccacccctcccctgcctagcctttccctggctacccacccctgccccgccgagaccggaccggcggcgggggcattgtttttggagtcgggcgggaggggagggcgcgtgcggggtggccggcgcagtgcggtgggggcgggagcgggtgggcacgcgcgcgtgtctctgtgtgcgcgcgggaggcggtggggcgggagatggggggcggcgcctcgcagtctcgcgccccacgcccgggctccgctccgcacgtcttggggaacccgggctccggttttttgcgcgcgccggcctgggccgggccctcggcgcgccgctgctgcggcggtggccgctcgagtgtgcgagcgggcgcgtgtgcgcgggccagggcgcgcgcgcgcgcgcgcgagcccccagtgtgtggcagcggcggcggcggcgcggcgaggctggggctcttgtttaccagcattaactccgctgagcggaaaaaaaaagggaaaaaacccgaggaggagcgagcgcaccaggcgaactcgagagaggcgggagagcgagagggacgccgccagcgagcctgcccacggccggcgctcgcagaccctcggccccgctccccggatccccccgcgccctccacgcccctcccgcgcgggggcagctccacggcgcgcctcgcctcggctgtgaccttcagcgagccggagcccccgcgcagagcaggcggcggcgggcgggggccgggcgggggccggcgcggggcgggcggcggcgcagagccgggcggcgcggcgggagtgctgagcgcggcgcggccggcccgccgctttgtgtgtgtcctggatttgggaaggagctcgccgcggcggcggcggcgctgagggaggaggcggcggcgagcggagccaggaggaggaggaggaggagggggagccgctcattcattttgactccgcgtttctgcccctcgccggcctcgcctgtgacccggacttcggggcgatcttgcgaactgcgtcgcgccctcccgcggcggaagctcgggcgtccggccgcctcccgcgcggccagggccgggcttgtttttcctcgcctaggcagatttgggctttgccccctttctttgcagttttccccccttcctgcctctccgggtttgaaaatggaggccgacgacgccgacagtccgccccggcgcgcctcgggttcccgactccgccgagccctgggccgctgctgccggcgctgaggggccgccccgcgccgcccgccccgtccgcgcacccggagggccccggcggcgccgccttcggagtattgtttccttcgcccttgtttttggagggggagcgaagactgagtttgagacttgtttcctttcatttcctttttttcttttcttttcttttttttttttttttgagaaaggggaatttcatcccaaataaaaggaatgaagtctggctccggaggagggtccccgacctcgctgtgggggctcctgtttctctccgccgcgctctcgctctggccgacgagtggagaaagtgagtatgtgcccgccgcccgcggccactgcgggaacttttcctccgaggggctgcgccctgtttgcgaaacccgagttgccaccgtcgcagctgtcgggcccccgggctcgggagcggcggggtggggcgcagggcggctctgccgggagggaggctgcagcggacccgggacccgggctcgttcgtctggagccccgcgggccctggctccgcgcatccccgcgcgggaagggcttttctctttctccgtcctgacagcccagccgtgtttcccggctaggcgcgaggactcggtagggaagttggtgccggggcgggctccgcggttcccgggccccgcgacccgcacctcgccccttccgtgcgcacgagcctctccgcacacagcgctgatccccctgcggcgcgcaggcagcagcgacagcaccctgggccgcaccgcgtctccgctgctggggctgaccgggcagtggggagcgggcagccgcccggcccgcggggtgcgagttgccctcgaggggggaggtgccctgcggagaggccccgaagccccaggacacgtctccaagcgcccgtcgctgcctcccgtcgcccaacgtgcttttgcccctcgggctcctcgggttcctggccttgcccgtcactttggcccgctcctcgttgggttacctgcccccggcgtcccggggctgggcggtggggtgaggggaagcgctctctgggcagccccccgggaagtgcgaggccgggagtcttcctcagcttgtctcttccggggagcgccactgggtccccagttcagagggctctgggatggtctcccagtttctcccgggccgggggatggaggggtactagggccgcatccgagtgtgcgttggtgggtgtgtggtcggagccgacgtgcattccgacacacgtgctcgcagcgcggggtgtagtcgccgcctcacggggacacctagacgcccgtccctggcgagaggtgtcgtacgctgtggtttcagcgccagggtctgcggcggcgcggggagggtgttgtgttttgcgagcgcggagccctggccttggttttgttgtggtcggcgtcgtgtcgccctctcttctgccgccccgcacttcctttgtacgtagttaataagcagtgtcgctccacattcgctgtcttttgcaatctgatagcttttgttttggtggtgtcgggtgggggttagtagggaagcgcggggatgcggggagcgagaactccccccggtgtctacggccggaggaggtgggggttttattcttctgaaaaagttgaaagtgtggcttactggtacattcaagatggtagggtaatttgaacacgattaaaagtttaaatgtcgcagaactgggactgggaacggtgagggcgtgttggtgagtaatggttgccgagggtatgcaggtggtgccgattaactttgaaaaaatcacgactgagccttcacgagtgaggcggggaaggaggaggcagcggaggttgtatggccccatcaccggggcaattcagaaaggctgtttctataaacaaatccttaaacgtctggtaagaaatgagtccgcgacggaacgagagcagatcgtggttcgcgtgtttactgccgagtgggacgcggactggggccggaccttccacagatctgggctctcctgctctttgttttctaaactttcagcggactcgattgggcgaaagccttccggctccctttactaagtcgtttaggtggtggctggggggacaaaggagggtttttatctttaaaagataagtacggtttagaagacacgggagaaataatccattttgttatgttatgcagttgaactgtatagcttctctagttttgtgtttttaatgttctgaaattcaaaacagcagggatggccttcgccgacgcaggagtcgggcattttaaaataggctgtttttcttttggagcgttcttcttgaaggatattgtttgtgcaagacggcgatttttgagaacacaggcaggagggagggggtgttttaatgtatgtttttactccatgataccaaagcttccccccaggatccctttacagtggttagttcctggaaacctgatgggtggtcagaaggcaccccaaatctcgattatggtttgctgaagtcttgactgactcagtacctgcccctccctccatctctgaaatgtggagaattaaaagctatgcctgtgaacgggcgttcagtttttagccgggaaggtgctagaccacttaactctgatagaaataagctgctgagccctatcagggagggcgttctttcagctgttgtctggtggagaaataaagacagggtgttggttcagttgcaggtattttgctggcgtattgagagattagagtttcctctttgagtgtgatggcagtagaaagagtgttgtttatcttagaaaacttagtttctgaagcagaggcagtcatatggatgtgtttgttttgtatcaccataatgtgaacagagcatctaaatgaaggcggttcggaggttctgagtgatagccagataatctgagggctattttgtttttaaaaagtcagcatgcactttaaatttattgtacccatctccttaaaaggattcagtcatctttctaccccaggcatcctgttgtcacagaaatgtaggtatgtgaaatgttggtgtttaaagaagttagtgttttattaccagaaggagaacccagaaaaagaacttctgaaagaacctaaacagcaaattatagtttagatcctctggagagacatagcaagcaaatggtgttttgtggaagggtggggtttgtgtcaggatttgaaatgtaaaaggtcataatgtttgatttgtcgaaaaagattagaaaagttcaactctaagaaatatgctaaggttgaatagatgaagcttaaaaatatcacaaaaagtgaaagaagtcagtcacaaaagaccacatatcgtatgatccggtttatgtgaaatgtctagaataaacaaatccatagaggcagaaggtagatgagtggttgccaggggctgggggcggatggaatggggagtgactgctagtgggcacagggtttctttttggggtgatgaaaattgttctaaaattagtttgtggcgatggctgcatagctctaaatatacttaaaaccattggattatatactttaaatcggggactttaatggtatgtgaattatatctcaataaaccctttttttttttttttaaagaaatgtgatcaggttgaaaataacttgttatgctaccttaaattacgttaaaattattacatatatttgacaggctgatgtctctctctcttttcatttatgagtttttcagatccgtgagttgcagcaatacaacaaactgataattgaagcttagcaacagggattcaatcccgcagtagaaatgggcaagcaggagaaaaagaatcttggttctatgtagcttcagttagggattgaggagctggatttaaaaaacacaaatgctggtggagggcagatttttgacaatagaaacctcagctgaatctgaaatgatggtttttttcaggatagagtttaggagctgagtctgaagggctgtttgtatttccagttttattatgttttccaacaaagaaagacattgctgttttaagatgttttaaacactcattttttgatatgccacattgaccacaagtggtagtaaggactgaggatgaacagaacagttcattttaatgcagtattgttgtttcttttctttgcagttttattttatttcttacatagttccagggtctgagcaggagaaagaatctttaggatgcagtagttttaggatacactgtttcaagtatacagtgatttttataaaattaaaattccttacagaacgaaaggttttaaaatgtggcaaaggcatttttgttttgaaactgtgtgcatttatccagatttaccctggcctttcaataggaaaagacctagagaataattgttgtttacatttgcttttggtctttgtctaaggcttagtttactaataaaaatgtttcctgcccttcctattgttgcaagatcagggcagtaatgaaaatcaactgtatcattttcacttgttgccttagagtttttgccaagaggaaccctcaagggacggtggtttccttttaaatctggtttcatttgttttgtaagaatgtgctgtaagaagcaactgaatccagcctgcacttattgtgcacctactgtatgaaagctgaccttgtgctactcagtgcatgaacctgcagagtcttgcatgaaaccacctttcttgaaattcagattttttttcagactcagtatagggtgcagttttcaagtagacagtagttagcattttaaaggttcttttaaaaatatttctgtagacttaggactctagtgttgttcatcagaagcctttaccctataccttttttgcctcattggtgctttccgttatattgggatgtcactgtagactgtgacatacaggtgatgttaacccatcttgactggcggcactgtcttctttataacattggatatggcaattgtgatttacaaactgcagtgttgtagttgcctttttccaaaaattaggagtcacaggtgtgtacatgaacgttgcatagcatgttttgagttgtaagaaagatggaacttatttcagaagttttctggattacatattgcttagttagctttctagaaatcaggaagcattcataatttcagggcattttataatttgtaaataacttggtgtttttaaaagcgtgagggagtaagagtgaggagacaaatcctgaaagtttttgttttttaattgtaaagcatacaagatacatttctttataggttgtgattttccccaatttgttttcaaaactcatttaaaaatcagacctagttcatggaagaggtatttgcgcctgtgggcgaacttgatttgaactgcttttcttagccagcttaggacaggtgctgagtccaggggatgagctcttctcaattgtactaaatatataatagttgcacacatgttacggatatagtttcttgatttccagtctgagatgttctgaaggaaaattctgaacactttagagacaacaaagtgcctaatgagtgatgcactctgatccctcctggaaaatggtgtttggcatcagcttagcaagaggaggttttccagttatttgtaaagatgtgatgtggctttaagtggggatgggggagggtagcagccccagtgtttgtggacattgagacctgttgacatttgggaagcataactgagttccactatttgaaaagattaaaactttgatatatgtacacatcccctcatgcctgcacccccatccccgagggtctggaaaagaattgatttgttctgaggaaggaacatatatttggaatataaaatggttagtaaacaaaggatctttaaaacaagttagattgttatctcaagagaagcatacttcctcggcatgatgttttcttttgttaaattgctttggttttatttgactcaaagtattaacaatacctttgattttgagacttttggacttttgaagactaagtttttaaatggtcaattttactcgtttgaaagtcccagataccatttttgaagatttctctccctttttttccactgatgccggctttacttatgttttattttcaaatcttaaggaaaaactgatatttccttacttgaactgagaaatagtcgttttccctccctcttttcttccacagtaaatacatgttgagtacttactggatgcagttctttaggtttagaaattatttgatactgtaaaatgtcttaccataagtttttaaagatacccgtcaaactatagatgttactgccatgtttattaaaaaaaaaaataaaacgaaacaaactagtaagcaagcttaaaatttttctttttcctgccctggactacagatttttttttcttttttttttttgagacagggtctctggtcacctaggctggaatgcagtggtgtgatcacggcttgattctgccttgacctcccaggctccagtgatcctcccaagtaggtgggactacaggcacacaccaccatgcctggctaattttttgtatttttagtacagacgaggttttgctatgttgctcaggttggactcaagcgatccactcacctcggcctcccggagggctgggatcacaggtgcgagccaccacccccagcctacaagaatttgtaaactcatagattgctcttctgttttcactggaccacaacagaaagtagtttcttttatggtgagggatgaacacctacgattgcaatataagttgttgggccttgtgtccatggagctcacttggtggttggtggtcttgaagcattcacattctttggagtagtggggcggctggctagtcacatggggaagatgtgcacacctgtggatggggccatcacacactgcagcgatagctgggcctaccttactgctcacctggctgggcacagcggctcctgcctgtaaccccagcactttgggaggccaaggtgggcagatcacttgaggtcagaagttcaagaccagcctggccaacatggtgcaccccctttctactaaaaataccagaattaaccgggcgtggtggcccgtgcctataatcccagctacgtgagaggctgaggcaggagaattgctgaaacccaggaggcagaggttgcagtgagccaagatgatgccactgcactccagcctgggtgacagagcgagactccatcacacacacaaaatacatatataaaaataaattgctcacctggtaatagtctggaaaacattttttttttgtttttttgcatattttaaagactttagaaagtagtcttgctaatccagaaagttcttgcggggaggagtttgaaactttgttttatctcactcctcagtcttagcccccttaataccataggtctctacttcagtaagagttacataatacgaatgccgtttgttcagaattgtgtatctccatccatccgtccatcgtccaaattctgcaagtttgaaatacattgttgttgctgttttgtatacttttgttcaaccattttctttttaacatggcactagctttctcaaactggctttggaattatttgtcagtttaaaaataaataccactttaaaaattactcttgacatgggagaacaaatatattttgatagttgttagagcataaatattttatagagcataacttgaaatttttcctgatacattgtgattgctttcagcttgtcctctgctgtaaaaaatatagtcgtggttagtctctgtaaagttggttattgggaatatgtgcttgattacgtaaatgagacatcaccaatttaagtcagccaaagtttagtcaatagaactttaaagaacagaagtctaatggtaattagggagagatgaatttatttgtaggagttttccccaaattcaaagcgtcttagtgacctttgataacttcctggaaaaagtaggaagcatggagagaaattccaggtaggagcccatgatccaattgactgcatcagcttacaaagtgttttctaagtcattagctattaattctgtctagattgtaaaatccctctcagttgtgtccacatttatctgtgttgtcctgtatttattctctttacctaatttccctgagtctcattttagtgggataatacacaagcttacagactcaggactttaaagagaagcacagattgccacgaaaacaaatgaacacagagaccagtagcagcagagggagatctgctgtgaggcttcccttagttctgttgtctgatttctgtggataatgagttcactgcatatgttaggtcacaacatgatatcgtgtagtcgtaggtacagaacttttgttatggtagcctttcttcgtcaggtgatacaattgggattttctttctcacatgcacctcagtaaaattttcagcaacagagattggctcaggatggaatttgttcagtttcagttctgcagcctgtccttttctggggagactcattaattgaatgttgcctttcgatctcactgagtcacttgaaatcgctcagattgacccctattccgggatccagcctggtccagtgcagacctgcattgactctgactacatgctgagttggcctctgaaccagttcctgtaccattcccttagtctgatggacttgccagctccaaatactcagaacgtgcctcttgtggtcctaggatcaagtccagggtccttagaatcaagtaatgaaacaggtccttagtaatcctgtgctgtagggatccactgttagttcctggtactccccagcatctgtgcattagcttgatggaaaggaagctgtgttatgcctgtcttcaagtttttgcttctgctgtttccatagctgagaatgtttttcctcttcactactctgctacttctccttccatcctcaatactgaatagcagaaagtgccgcttaagaacacaggaaggtcaccatagctttagtttctccttagctgccaattagttctttggtcctaaagttattaacttttctgagtcttgatagaaatgcggagacttaaaaatatttgggggagacatttctccttttctcactaaacaacagaatgaaaaccttttctaacaggtttagaaaaccaaagtcagaaaaattgtgaggaaatagaataggttttttaaattgaaataatttccaagttccaggtggatctgtaaaatagggacaagatcataactttcaaaaggcagcacgctaagtcaggtgattcctttcccccatatgccttttctgtggtttgaataggtcagagatgccatctttacatttccaagtcaaattcctcttccttcttgaaggtttttgggatttccctaacttgtatagatctactttcccattactccttttgagttcataacccacggttttgctggttgacagtgatttgtcttgttccttgcttgtaattttattaggaccatggagccaaagtggctggtttgaatctcagctcttcagtagctaagctctcaggcaaataatttaatcttcttgtgcctcagtttcctcatctgtgaaattataattttaatagaatctactttaaacattcatagaaatcaaattcgtacacatgtcaagtgcctagaatagaacctggcacctggtattaagcccttggacttcaactgctactgttcttagggttgtgacatcctcgaacagagatgttctttggatagaaatataaggcttacttgatgtttgattgtccttgccatttaaatatgttatagaacctggcacataggtgctcaataaatgtataataaaactttattttgctaaggtgtttattaacaagatggcatgttgcttattaaacagttgtgattttttttttcagtaaacgatggtcatccccctgcagtttgccttccatttcagagatctgtttattacactttctcccttaatattgtcatttgtcaatttctgctcacacctgagaggtgtccagtgtgcactttgcccatctcgcctatgcataggctccatctagtggccagaagggaaattcagcatattaggtgactgaattaatagtgccccaaggaggaagatagcgatcccaacccactctctggcttgcttcctggggactgattgcaagaaaatgtggatactacagacttctgtagaaatcactgggctacagttttggattaaggttactctactgtgtcagtgcgagctgtcctgagagaattagggtcttcctaagtgatgcagacaggcgcactgcaactccatggcagagctgttaacacctagtgtgtcttttacagttagagttttaagataattttacaggactttaataaatttaaagctccaaaatatttgagattagagattaaaaaaacactactgatttcatttggaaaaatacagcaagatttaccttccattgctctatttaaacaggtagtaacactttcattctcttctctctcccctttggctattctatgtggttaagatgctcgccagccagaaatactcacagagaataagaataaatacatccagtgttgtgttaggtcccacaccgtctatatttcgctagctaattttatgtattttgtttcatgttttattgatattttcagaatctttcttgctgagattacacaaaatatatagctggttattcagttttacgtgtcaaaagccttaaacctgtttccccatgattgccttttattatttttaattcggaaatctttgtttggctgtctgagagagaacttcagcctcccttcctcccagacattttgaacagttcaggctgtactcattcgtgtctctttgtcttggcaggtggaagcccctctgcttggaatagcaaacaatactaccagcttgccctctggcaagctcctttaagagttagctgtaatttcaccctctctctggccttgattctgcatgcagaatgattgcactgacttgagctcctgtggtctcttgctatacctcctatttgggcatctcccccatattgctttcccccaccattggggaggggaatggtaccttggttatctttgaattcccaggaggtggcccagtgcctggtgcataggaggagctgaagaaacggaagacttcttaaagggatactcgccattcactttgaagcacttctttgtacaacaaatttattttcatctgatcattgcacctctgctagccaaaacattttatcacaccagttactgctgcatggaacttgaaagcaataaaattatctttaaaatcattgtttgattaggctttttgcacattgaggtgaataaaaaaaattagaactcctggaagggtaatttgtgagtctggccttgtgtcaagatcacctcatccctgtggatggagactttgttccataagttccctatagataagatgtaatgaataattcattggcaccgatttatgtctgtagtgtgcttttaaaccctcctggagctgggttcctgaggaggaagcatctgcaggctggactcggctgcctggtggtctccggagtggcctggtgcagagggccagggtggcatctcagaaagttgggtgggtagggtacttgcacacctgctgaccttgagttacagggtggacctaggtcatttcacaggcccttccagccttcagatctcaagatactaggcagagagagagatggagatttgagggagatgtggttggaacaagcagaatcaccacgtatggaagttggcttctattttttgcattgttttcttggtgaggccagtaagcttttgcctcactcctgggagggacagtagcaaggtcttacaggtctctctatcattgaagcaccctctccaaccctgccggttttggttgctggtgaaggcctttgacagtgtcctggtagggcgacggtgaggccagctcccgacctctggacagaagaaagcttacttgtctaggttggtgtcaaggggactcctgaacttaatgaacaccttagaaattatccttaaagtctcctcttccgaggagtggggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctcccaggttcaaacaattcttgtggatcagcttcccaagaagctgggattacaggcgtgtgccaccacgcctggctaattttttttttttctagtagagacggggtttaggcatgttggtcaggctggtctcaaactcctggcctcaagcaatccaccgacctcggcctcccatagtgctgggattacagatgtgagccactgtggctggccaaggagggtctttttttgcacatctacagtgaaaggtttgaacccggacgtctgagtctcaggtcagttgttgaaaccactaagtaaccaccttgcttctctgtgcctgaagagaatgggtttttaggttaaccaggctgactggttcaaggtcatgtccctatctgtggaaggggagtgggagtggaaggtgagtggtgacagagtatggaaccctgtttctgatatctagattatttgagggcctccagtggtctctgctccatggaaagcatatgaaagaatatgattttttttttttactcgagcttgttgtctagttgggaaaactcaactactggtggagagtaacagatgctatgagtttagtgctaagttatgggatgctgaccggagagaagtatgtgggctgcaggcagtggggtcacggaactgcagaatggcttgagaagctttaaggaggatgtctgactttagtgtgccctaaatatttgactctcaagatccaaggaggcagctccccaggagaggaagggaccatgtgtggtgtgggtggcagtgtgcactgatggagtggagagggtgtcagaatccggtgtttgtgtggtgggaaggaattgactgctggctagagaatgaggagcgctgaaacctttgcaccattgcagtggacccgctgagaagggtgttctggggaggctgctctggtctctcgatggagtcaggattgggggacagatagacaccccggtgtgagccagtgatggtatagatgagggaggcagtgaggacaggctcagggagggaagtcttgtctctagacctgagaccaggaagcaggaatggactggacaggttggcccagctgagggaggtgactggtgagatgggtcctcggtgtgaggggctgggttgccagaggagctgtgggctggggtggtttgtcgagagagcagtcccagttgatggagaggcaggacccgcaaaacaggttggctgcaggactgggggcggtagcacagggcagctcccgaggagacacctggcacttttaaggcatggaatggagagagctaggggagagcacacctgcagtgaggcaattcacatagcaaagttctccggaaactgcagtgttcaacttttttaaagaatagctggatgttagaaaagtggaggaactgtcacctttattaggggcatcatggatacctggtagcatcaagggctagggttaaaacccgtggagtaatacgccctcctattgtgttcctctcctctaaaaatgaaggtgaaactgtttcaggtgagcgctgttgttgttcgtttgctggggcactgctttctgatttttagaggagtccaggctggagactgacccctgcctttttctgagttgggccggctgggcccgaggctggttctgggctgggccaggctgatgcagtggccttgggcttcccgaggctgggagagggcggtggcccccgctaccctgaagagctggccaacgcggcagggctctttccagtccttaccatgcaagtgaagaggaacagtttgtttaaagaggggtgccagcttcacatccaggcctggactttgctactggtgcttttgaacttgtgttgatttatgtttgtaaattgactggacacattgtggttcttgatgagaagcaattgcccatccttagcccacgattagtgccactctctgggtgctgcctgttctgccactgtaactgttttcacttgacaaataacattaaaaaacacagttctgcaagagacttcctgggagggtggtatcatttggcctgtgggcttttgtaacactttcctgctattaggagagtgaattctgaattttcaatcacgttcacctgttggagcaagtagagtttcagacggtctccgcttttctcgactagaaagcaggccttctcccttttccccccagtcttgtttcatgacaccattcccctctgagatgagggttggagaattagaagtctactgatgcattgtaccggggcacgttattgaccctctctgctctcctttcctcatctgtaaaatggaagataatgccacccatcaggccgagtgcggtggctcatgcctgtaatcccagcactttgggaggccgaggtgagcggatcacctgaaatcaggagttcgagaccagcctggctaacatggtgaaaccctgtctctactaaaaatataaaaattagccaggcacagtggcatgcacctgtaatcccagctactcaggaggctgaggcaggagaatcacttgaacctgggaggtggaggttggaggttggaggttggaggttggaggttgcagtgagccaagatcgcgccactgcactccagcctgggcgagagtgagactccatgtcaaaaaaaaaaaaaaaaagtgtcacccatcttggaggatcgttaccaatacttcatgagtgaatacatacacatttcttagaacctagggtttataaacactaggagttagctgatactgttgttgctaaggatagaggaaatacgcattagaagttatttacttcctttaaaaaaaaaaataccctttgggtgtgtattgattctgatgttttgctcctagctacatttgccgtttttttttgactgcagaattaggaaccagcttcatttttttttttttttttggatggaatctcgctctgtcgtccaggctggagtgtggtggcgcaatcttggctcactgcaagctccacctcccgggttcacgccattctcctgcctcagcctccccagcagctgggactacaggcgtccgctgccacactaatttttgtatttttagtagagatggggtttcaccgtgttagccaggatggtcttgatctcctgaccttgtgatccgcccacctcggcctcccaaagtgctgggattaaaggcgtgagccaccgcgcccggcaggaacccagcttcatttcttgtaaagagagtttgacaagcgctccactggggatagcagcacagcttcctccttttctgtccctgtctccctcctgactctgcatctgcctccgtttgaagcatcctcctccagtaagtgggtcatttggattccaaggcccttttgaggccatggtgatggatcatttgcgttatcaatgtgaactgtggatgtcccttcgcccttcagtctcttccttcttcaaggagggggaggtaattgggggtcatgtggcctggggaagagcctggtcacgagcatgagggatgtgagtgggactatgtttccagccaaaatttagggcacaggatctgaaaaacacttagattaagtatctgcaacacaaattagggtattttaaattgaatgtggagaaccctgagaacctgtgccctttgtgcgtggatggctgcttgcaaggatgagcatccccagctggagcggcccatggctgccagaacaggagaaggcttcagtcaggtgggaagccagctgcagtgtgttgcctgatgcaggatggtgcgagaaggagctgctctcttgctctgctccctggatcgcacaaggtcttcctgagaccagaattcaaggttagtcctgtttaggcaacttggtagatggacttgaatggtctttgctaagcgaatattgcctatggtggtatttgcaaggaaaacaaaagtgttttgagcccagactaaccaatttaacaatgctagtaggtaaggatactactgtttgctttctgtgatgagaggtctcttaggaggaggggttaattcttttgatttaaaacttactacttgaggcaaataggcacatgaaaagatgttgaaagtcactagtcattggtgaaatgtaagtcagacccacaattggtacttcatactcattagtatggctattaccaaaaacaccagatgatagcaagcataggccaggatgtggagatgttggaacccttgtgccttactggtgagactgttaaaatggcacagccttttttttttttaacaggaagatgatatggtgcttcctcaataaattcatcatagaattgccatatgatccagcaattccactttggggtatatgcccaaaaagaagtgaaagcaggggctcgaacagatatttgtacacccatgttcatggcagcaaataattcaaaatagccaaaaagtgaaagcaactcaagggtccatccatagacgggtggataaacaaaatgtggtctatccatacaatggaatatcattgagccttaaaaaggaaggaaattctatgatgtgctacaatgtctgtgaaccttgaagacactctgcgaagtgaaagaagccagtcatgaaaggacaaacagtgcataattgttacccttacgtgagctatgtagagtagtcacattcatagagacggaaagtagaatggtgaggggcggtgaatagaggctggggggagggagcaatgaggaattggtgtttaatgggtacagagtttcagtttgggaacatgtaaaagttctagaggtggatggttacggtggttgagcaacattgtgaatcagtgtcagtgaactatacacttaacaagggttaaaatgttaaattctttgttgtgtatattttaccacaattttaaaaagcttatttctcaattgtttatgcgagtatatgtgtggaatagttggggagacaaattcaaggagaccagtccttgtccatggcggtcctaggtaccacgggatcactgcgggggaactgtgaggtcaggagaggccttgaaaaaaaacgcaggtttgagctgagtcagatggaatgggtctgttttctatatcaagagacagtattgcagataatttttttctttcaaggaaagcaagtcaggagtcaaactctcatgccaccgtagtcacaaatgaaatttattgctaatcagccatgtgacgtgtaattgctttttcattttcttatttttccagaagagagatttgtttagatgtttgattccctcactgattatgattatactggaagtttttcatttgttttgacagctcaattttttttttattgtaaatggactccctcattacagaggggggagcccttgaaagaaagggattgacctctgcaggcaagaatctgagcatcctaaaagtagaaaagggctagaggcttcgccttacaggccaggaagcttggagggacgcgctgctagagaccatggcacgcatgctgtgtgtcgaaggccaggtccgcctgtctgcctctccagcagatactctctggggctatttttttctgcttggttgtcatcttttggtttaaccaggcgccagggctcaggcctggacctgctggattccaaagaagacttcgaggtggccgagcttgtctggcttccagaggagctttctctgtcccgcccgggggagtggctcaccttggtctgagaccaatgggaggaagcctgctgcgggcaactggtctgtgcctggaagttggacttgcattttctctggacctccaaagcaaacccgaatgaccactctcatcctccccttttgcttgtttgtgtatgtgcttgttttgcctggtcgtcaggcaggaggtggtgtcagatgatgagaggtgttgctcgtccctgggttggttctcttacggggctgtatggatgtcttagctcagactgctgtgacaggttactatagactgagggctaaaaccacagacttatgtttctcacagttctggaggctggaagtctgagatcaaggtgccgaccaaatttggtttctgttaagggtccatttcttggcttgcagatgacaaatgtcatgtgtcctcacagggtggagagagcaaggggctctggtctcttcctctttatgtaagggcattgttgccattatgggggctctaccctcaggacctcatctaaacctgattacctccctaaggccccaccttcagataccactgaaggtatctgggggttggggcttcagtatatgaattggaggggacacagtcatgcagttcagaacagtggagcagtgtgccatagtgaagggatctccagaccaggattctctatggaagttcttggccaggtctgagagttggttacagatcattaaaatttacatggaatccagtacttgaaagtacatgtcttcaggatggcgctgagcacattcgcctctgtaaccaaatgcctgaaatgtgtagtgcaccttctgagcaccccagtgctttccttaaagtgaatgcagtttgagaggaactcaattattgagaaattttatatgaccccatttctctcattttaggacagataagttgcttattttaaactctgcaggagctacatagaggaagttatactccaggagagcttaaatttcactctctgaaaactctgttccatgtaagtacattcctcctctctcccctcctcagtgagcacgtacccatcagatgtgtggaattctattaaaagcagctcctcgtgaccctccagggttttgtaaagctgacaccagcatcagtgagttggaaggggctgccacagaagacagacttactgctgcagcccgcttcagagccctcagtagtactttttcctctcccagcaaatccaggaggctgggaaggtgattgttaattgtttatgagcattaactgtttaccagtcatacttactattttaaatctgaccctgccattatgttgttttgtttctgttcacagctgagctttaagctgggtagaatttcgtgatgagtcactcctatgactgtaaaatcagtatcgatcaagccttcctgttcatcctgtgagcagtttagagacagatgagacaggcttatggtttccactggctcggctccgtgcgtgtgcggattgggcttcctgagagcctggttagccccttttatctgctctctgaaacctgcgcaagggtttttagcatgcaccttgaaacctctgctgcctgaagacagtgtgcttaaatgaagggtatacaaacccatgtgaggttttctcttcccttttccatgaactccaccccaattacctgtttgaattttgcatgccagttattttcagggaactagtgacccttttcttgccaccctgggctttgaattgaaggccagtgtgccaccttttctttggctttgttagaacgttgccctcagggtcatatgtgctggctgctatgaattcttactgcttgatggacagagaaaggtgagggttagatatctggacagggcatgacagggcgggtcatcgagtaggaacattgggaccttttgcttccaggcttgagcagtgggtgagaaacactgtcttcccattagggcagtgggtgaaacactgacttccctccatcctctgggcagccttgtcaggtgggtgtggaagctgaggtgtgtctgccccaggctgtgcagtcagccccgtgttctagcttcccgtgccgaacctggccctggaggctgtctgcctggcaagggggctgcacaaagctcggaggggcatttctggtgcttggtagatggtaggcctgcccccagtgcactgataagagcatgggctgagagtgccacttggattcggctacagtgggcggcagagtgggggtgactggtgttgcttttactctagagcagaggaggcagatgaggtagatcggggccccagggatgctgagctgagctgggtagagagaatttggttttgtaggatttggagacagagacaaatttggagtgtttggatgttcggggacctgcaggaggtatgtgaggtgtgtaaaatgcagcccctgttttataaagagcttacattgtctcttgagaagataaggtgtgcccagctgtggaatggaaccagatgcttttatgagtgaggatggagtgagcacactgggaaagagccctggaattggaggaagagatcattttgcccagagggatcttggaggtctcctggaggagggtacttagatgatcagaaggattatactagacttgatggggtggtcttggcatcagaactttaaaaatgtattttggggctggaagcaaggctggagaggaaggtttgtttaagttgtagtgggggatgaggctgggggcaaatcagggatggttttccaggtctgtaaaggctggggtaagaggaatggttggttcttaagagcaaaaaaaatcccttacatattggttctcttatttgtgctaagttaaatacatgggaggctactggtgtttatgaaataaccctgagcctttttggggaggtagtagtggatgtctgatggaagagatagaagactggtcccaggggttcttagtggcaccttcctctcaggtcatcactgtgcttttgcacattgcagttatatttgactacatttgattatggcagatttacttagaagggcactggaaaaaagcctcccaaattacaactgacacaggaaatgactttattttcttctattttttttctttgcttttctcccccaatcaacatacatttttaaacctgtcatctcacatgacctgccggtagaattgatatgtttaatttctgtagaaaataactggaaatatttcacaagctccagtagcttcctgttgtagggacccttaggactttggaatgagaagttttctattgagttgtcatatttggaaggataaaggtgccctcttttccctcgatccacatagtagactcctgtgtgcgggcatttgtttggtgtctcacgttgatgcaaatgcagccattgcagagtgagccccgctctgttactggatctccatttgctcaaaagagagcagtgtccccctccaaatctgcatgtctgaaagcattcatgcaggttcattgcatgggtctttgcattttacttagacttagcaaaaatcaggtatagtctttcctgaaaacaaaagtgaccattgtttttaatcaactgcagggtgtttggagttgtgaaatatttagggtcccgagtccattccagattcaacattgggaaagaatgagaaagctgaagcctggggcaggctctgtctgcagaaaccatgggctatcaccccctctccttagcagcattgtaaacaaacgtcatttgtaaggagcatgtcccaactgagcttgtaattataggggcaagatttgtgtggtggtaggggcatggagctggagactgggggcttccttattggttcatttatcctggcccttctcttttctctcaagtctcagctcttttaagattcagaaaataatgcaaaatgcctaagatttctgaaattcctggcttcagagacttgactacataaaagagccaggattttcaggctggccatttcaggatcagccatttcccacttcctgattcatagcttccaggatttgtaatgcctgtagacttttttctctcttgcttaaaagtggccattgaaagaaaaaataaatagcaaaatccccatcccagaagttctacttcctgttgttgtactattgagctctgaaaaacagctttgtaagtttaagctcttgtttggactatttcagtggaattcttgagatctttttgtttggacaggcaagtatgaaggcgataagtcgaaagaactacagcttactcagcacagaaatgcagaggctcaaatttaagttcttccttagctttatggtgtgtatattaatataatccaagcaatagtgagttgcttagccagggtgcacagacattttccacaatgccagttgtttccctcataatgtttaatgtttatttttaaaggacatatttgggcacacgtttcatttttgcctgtaaaagaattgggaatatttatgattcttgcaacaaaggagaaggatccaaagtaaccaagaaaatgatggactggcagccttcacattttcccacaactcttttcatgaaataaaatgtagataaggctgggtgccatggctcacgcctgtaatcccagcactttgggaggccgaggcgggcggatcacctgtggtcgggagtttgagaccagcctggcgagcacggcaaaaccccgtctctacgaaaaatacaatacaaaaattagccgcgtgtggtggtgtgcgcctgtagtcccagctactcgggaggctgaggtgggagaatcacttgaacctgggaggcagaggttgcagcgagacaagatggcgccattgcactccagcctgagtgacagagcaagactccatctcaaaaaaaaaaaaaaaaaaaaagtgtaggttagcaaaagtgcctacagttcaaatgcttccatgctaaacgttgtatttcttccggtctcatttgtgatgagagtcataagattttgagaaatacaaaaacctttccagctttataggatgataatggcttggccactcaagtagttctgattgggttaactaattttggtccagtaatcatttcatttggggtgaatggatttttcccccctaaatacgggtacctggaaagttgaagcagtgaatctggtgaaacttaatcagtgatttcgtaagggttaacaaatgtttctgggtgggattcctaatgtccagcttcctctgtgtagctcagtaagtcttctttggagacactagcctgcattgtaagactgtcacatgggagcatctttttattttattttacttttttttaaaaaaatgaggtctttattatcctggctggagtgcagtggtgtgatcatggctcactgtagccttgaactcctgggctcaagtgatcctcttgcctcaacctcccaagtagttgggctgatagacatgagctactgtgccacgtagcattcttggggattattgtagggtccttttggaccacacatggttttatactctgtagctgattgatgtactggcatgtcagtgacattgtgtgtatcattacactatttggttaattgatgtactggtggaatagccatcttctggaggctcttgtttgcatacttctcttagtggcggactagcggttgtacagtaaatagatgatcattctcgctctgttttacctttcctcagctgctcttctagtaggaaaataacagccctcttagctgtagtcttctggaggctctctcaataatagaagtggaaagaaaagactcaaatccctgggcagtgactttttagttgtttcatttgcttttaaggcagaaacacctttaactcttagtagccttacagatcatttttgaaaacacctgtgcttgccttgaatggggcggtgaccactggatccccccatgctgggtacatgttttgcagtcacagacactgctggcctcacctttggtggtgaaggaatgtttccaatttctgctgatggtgtagtgctcttgggagctgggtgctctgaatgagcagatgggcatctgcttttttaagcctgctgttcattctgcaaaatagttattgtgcaaatacctgataagcaccaggtctgtgccaggcgctgtattttgtattttgcatgtctgaggccagcatctttttccctgttcctttttctcctcatccagtgaactttccactgtggttgtagtttgtctgaaaaagatttggaaaaaatgtacagccatgtttctcttgtctagagaagctgtcttaaggacttcgacaagtttcattggcagagtgaatgagtggtggcctctgaatagttgaaatgttaatgctatctataggttctagagaatctgtgtctttaaaagtcatagcgataaagtctcagctttttgagagagtgggtttcagacatactactatacaggaaatctgattgttgcattgaaacaggatttgttatcacatcacggttagacatacccaaaaggcaaaaactacagtggtcatgattgctttacataagattttggaggagaaactgttagctccatgaaagcaggaactgtgttcactcttgaatgcctgctacctgcacatggtgaatgttctataaatgtatattaaagaaatggaggtccttagagttccaagatcaccgtcaatatcatcaccctaggcttcctcgtccttccagttacttcttttccagaagagtccattgcctcctttatatgaggtctacagagcgcgttcagagggctcttatcattgattcagcaatcacgtgtacacatagcactagaatgacttcacatatttgacctgtttaaaaataacgtgcagctatgacgaacagcgaacctttgattagggacacatttgcctgccgccagacactacaagtattatgtgtattgcttttttcaaattataatagtaatagatgattatgagaagaaaattagaaaataagttttctgtctctctataaaaggaaaataaaaattatccttaatctcaaggtaaccattgttaatattttgttgtgttttcctgagattttccccctagacttatatgtgtatctatatatttaaaaaaatgaaattagtagtatactatgtacacacatattgtgaatttctgcccataacattatatctttatcacctggaatgaggtctttaatgaaattattaaaattaaaattattctataaatgctaaatttaggtattttacaatttttttttttttttttttttttttgagacaaagtcttgctctgttgcccaggctggagtggactgcagtggtgcaatctcagctcacttcaacctctgcctcccaggttaaagcaattattctgcctcagcctcccgagtatttgggactacaagtgcatgccaccatgcctggcaaatttttgtatttttagtagaaacggggtttcaccatgttggccaggctggtctcaaactcctgacctcaaatgatctgcccaccttggtctcccagagtgctgggattacaggtgtgagccactgtgcctggcccattttataattttgatcattaaaaaatgatgtgataaaattattgtgtattgttgttgatacactactctgattaattctttgggctagattcctaaaagtggaaagtaaggaataagaattgtgtaagtgtgcatgatcctagataaatattgccaaaatattttgcagaaaattcttagtttcagcttccagaagcagtgtctgtcatccatactccaccagaattgaacactaaattgagctttgcaattttagcatttaaaaagttgtatcatttaatatagaatagcagtctcttcattatgatcttcccttgcctagtaagtttatactcaagtcaaaatcggttaatcatgcatattgattccttgtttatctttttcttttaattctttaatacttctagaatgtatttgtagttaagtgaagtaagatacctcctcctgttgacgatttagtttccccacattgtgctgttttttttcttcactggattatgtaacaatatcttttcttttttttctttctttctttttttttttttttttttgagagagtctcgctctgttgctcaggctggagtgcagaggtgtgatctctgttcaaagcagcctccccctccccagtccaagtgattctactgcctcagcctcttaagtagctgggattacaggcgtgcgccaccacgcctggctatttttttattgtatttttagtagagatggggtttccacatgttggcctggctggtgttgaactcccggcctcaggtgatccgcccacctcaccttcccaaagtgttgggattacagacgtgagccactgcgcccagcctagagactctattttattagtgttttttgtagacaaagtctcactctgttgcccaagctggagtgcagtggcgccatctcggctccctgcaacctccacctcccgggttcaagcaattctgcctcaacctctcgagtagctgggactacaggcatgtgccaccatgcccggctaatttttgtatttttagtagaaatggggtttcactatgttggccaggctggtcttgaaatcctgactttgcgatccgcctgcctcgacctcccaaagtgctaggattacaggcgtgagccaccgctcctggccgagactctattttaaagctgtcttctcccactgatttgccttttgtttgtggtaaaatcattttgtcttaaacactgtagcttcattatacatgttaacatctgctaggaagaatctccactcaggttaaaaaaaaaaaaatttgaagcaccattatttcaggtgaactttgtgtgtgtgtatgttgttttgtttttgcaattcttctccgctactcttccaaaaaagaaaacacaaatttattaggttttgattgttaataaatcagtttgggagaaaacatttccagatatttgaattactcattcaaggacatttcgtgtttctccatttactcaactattatctatctatgaagaaatcacagaaggtcatagaggttgtatacttttccttttgggttatttctggttaatgaatgctttttgttgctaatgtagaaggaatctttattccccattgtttattttatatttttaaattttttttcaattaaaaaaaatttttttttcattcctgagacagggtctcgctccgttacccaggctggagtgcagtggtgcggtcatgactcactgcagccttcagctcctaggctcaagtaatcctccacctcagcctcctgagtagctgggactactggtatgcgccaccatgcctggctaagttttttctttttcttttagaggcaggatcttgctgtgttgcccaggctggtctcaaactcatgacctcaagtgatcctcccaccttcacctcccaaagtgctggcattgcaggcgtgagccaccatgcctgaccttccttgtttcttttaggtgattattggttgtgtgtgaggaaagctctggtattttctgtacttatcttgtacctacccaatttgttgattgctcttattcgttataatagtctttcagttgactcttcctaatttttttgtgccgagaatcattgatgacaaataaggataatttggtctccatttttctggtacataatacgtctttacttaccatcagttgtgtgtcacttaggaatataaatggctgaaaataactgaaagcctgcctaataagggagtaggccgacaggggctgacttttctcaagttcaggcagtctggagggaaggagtctgtggctgctgtgaggtgctcaaagagggtgtgaggactgggctcctggcttctgtttgttcatccttagcctgtggcttttgtcctcgtgaacacaagatgacctccaggaattatgtctgtttcaggcaggaagaagttgagaaggaatgaagacaaaaggcaaaaaaggcagaatgacaggtcagcaagcgctgctcagccagtaggccctgcttctccttggccagaactgagttgcatgcagctggctagaaggtgggagatgaatgtgggtatggctagtgggttgggcatgggggttgggccaaccaagcatggttggtcatagggtcttgctgcattagcctgcacatccagaattgttacatgttgattacaggcatatttgtccttttttgtctatattaatgataatgcctctgtttctcaatgtgtaaggcatcttttggtttaagaggttttcatcatgttgaagaattgcctgtcttgttttcttgggtgatttattaaggatgggtgttgaatgtcatcagatgtcattttggcattcatttggattcagaagtggttgttacacctattaattgaggtaggaatagattacctagtagtaatccctcctcaaattcccgtgttaaactatttttggttgcggtgggtggctgtttaaattcctaattaaatttggtttgctaacatattcagattttttaatctcttattttaaatgagatagctttacagttctctttagatgagttcttttccagattttgctgtcaggcctagactagttttgtaaaatgaattaatgacttttcctttttaccttctctgtaacagtttttatagtgtggcaataaactgtcctttgaaggtttggaacaactcacttgttaaatgcctggaggctgacacttaaaaaaaaaaaaaagaatagtttttgttgtgtttctttttgttgttggtgttgtttttagtcttcagtgcagtggcataatcttggcccacttcagccttgacctcccaggctcaagcagtcctcccacctcagcctccctggtagccgggaccacaggtgttttgccgccacacccggctaattttttattttttttgtagtttttgtagagatggggttttgccacgttgcgcaggctggtctagcattactgggctcaagtggtccacctgccttcgcctcccaaggtggtgggattaacaggtgtgagccaccatgcctggcgtaaaaagatggttagtttttgttttgtgacagctttaaaaaaggtcttccatgggtgttggtctgttccagggttctggttctttcctctgatgctcttttttttttttttttgaaacaggatctcgctcttgtcccagatggtgtacagtggtgtggtcatggctcactgtagccccagcccactgggctccagcaagcctcccacctcagcctctggagtagctgggacccatacctggctaatttttaaatgttttttagagacagagtctcgctatgttcccatgctggttttgaactcctgggatcaagcgaccctcctcccttggcctcccaaagtgttgggattacaggcatgagccaccatgctggccttctggttctttttaaatcaattttagtaatttagtaatttccagcaagtcaattaaaaattatagctcagttgtatgtagtattttctgtgtggtgttatgccctctgtatctgttttctcagatgttttagttgcttttctctcttaatcttgattagacctgccagagctgtgcttattttgtgtccccatccaaatccagaattaattgccgtgctccacatgttttggtcaatggtggacctcatctgtaacagtagtcccatgagattataatggggctgaaaacagtgctgtcccctagggatatcgtgtctgttgtagtgcaaggcactgctcacgtgtttgtgttgatgctggtgtaagcccactgtgcttccagtcagatgaaagtgcagcgcatacaattgtgtgcggtacctaatacttgataataaacaaccatgttactggtgtatgtatttactatgctgtacttttaattgttagagtgtactccttatacttattaaacacaaaattaattgtaaaatagcctcaggcaggtccttcaggaggtatccagaagaaggcattgtgatcataggagctgatggctccgcctgggttactgcccctgtagacttccagtgggacaggatatggaggtggaagacagtgacatggatgatccggaccctttgtaggtctaggctaacgtgtgtgtttgtgtcttagcttttaacaaaaaagtttaaaaagttaaaaaaaaaagttaaaaatagaaaaaagcttatagaataagaatataaagaaaatatatacaagaaccaaaatttaagaaaaataaagtttgtaaaagtaaaaaaagttgtgcttaagctaagtttaatttattattgaagaaagaaatttttaaataaatttagtgaggcctaggtatacagtatttataaagtctacagtagtgtacagtaatgtcctcagccttcacattcactcaccactcactgactcacccgagggagcaacttccagtcctgcaagctttattcgtggtggtactcccatatacgtatgtatacttttttttttttttgagacagagtctcgctctgtcgcccaggctggagtgcagtggtgcagtctcggctcactgcaacctccacctcccaagttcacgccattctcctgcctcagcctcccgagtagctgggactacaggcgcctgccaccacgcctggctaattttttgtatttttagtggagacagcgttgcaccgtgttagccaggatggtctcaatctcctgacctcgtgatccacccacctcggcctcccaaagtgctgggattacaggcgtgagccaccgcgcctggccttttgtttcgtttttaagagacagggtctagctctgtcacccaagctggagtgcagtggcgtgattatagctcattgcagccttgaactcctgggctcaactgattctgttgtgtcaccctccccaagtagctagaactacaggctcatgccaccacacttggctaatttttgttttttaattttttgtagaaatggaatctcactatgttgcctaggctggtcttgaactcttggtgtcaagcaagtgcttggcctctgaagtgctgagattataggtgtgagcctggccatatgtactttttttttttttttttatccttcttactatatttttattgtaccttttctatgtttaggtatgtttaaatacacacatacttaccatggtgttacaactgcctgcagtattcagtgcagtaatgcactacaggtttgcaggttggtagcctaggagtaataggctatactgtatagcctaggtgtgtagtaggctataccattgaggtgtaagtatactctgatcacacaatgatgaaatcacctaactgtgcatttcttagaatgcatccctgtcattaagtgatacgtaactctgcttctttaagcctctgtagcactttggttatgttaggattctgtgtctttacaagtctgctttgctgatcgattgtgacatcttgagggcggctgcactactttctgcctgcaccttgtttcgcatgtctacctggcgcatgacatacacctcgttgttcagttcttgcttctctgcttgtgtctttgcattcaccaccagctattctgatagttatcaggaggttttcattgattgcagtctcgtgcaatgggtgcaggtaatgggtagccttatggaggagaaaatgcttacctatttgggttcattccaaggagtagttcaaggataaacctctaagtttggggagtgctgtaatttgctggatatgtgagccatagaagacagcttggatggcatctgatgcttcctggctgcagggatggaggcagcagaccctcctgcctggggtggttggttgccatccctgtcgggggctcatgctccaccctcaaggctattcttgggggagttgtgacatggctttcataaaaactcagtggaattttaccctgtgtattagttagtaaaggtgagtctggttcagttggtttgagtcaaaaaatctgttaatatctctgctttagacctgcatcaggctaatacttgaatttagggtctgtccctggtgtcatctgaatttttgtttgctatgtgtgaccaaggagatggtcactcttcaggatgggtgggtggaggggagaaatgctatgatttctgttgggtcatgtgaaatcaatttggaatgtggatggggcccttacactttttcttttgagcttagtgattttctgtgtagggtggagagcgattaggaaggaattcaccacccttaggtcctcaggcatagggtcttctaggggcaggactgatgagtgaacagcagggtggatggagcagaaccgttggaaccttcagggcaggacctgccaccattatttggtcacaggaagtgttcagtggtgaacttgttggaaatgattttgagtaacttccgtctcctaaatcatattaggactctttggtctcctatggttatctgagttgttttccaggaggagctgggaaggtaccaggagaaagatgactgtccctctcatgtttgctgagggtgttcctgtaaggtgagctagtgttccttttagggcccgtggagaccgaccttcacattgaagaagcatatctgtgctccgagatgttttcatggggagaagtgtcaggtgtaattataaaaggagtctttctctttaaatactgtaggcgatttagaaatagtggaggtttaattgaagagcttgtctacgtttttacattttccttaggcacagagaaactagtatctttctctgggttgcctttttttttggagacagaatcttactctgtcatccaggctggagtgcagtggcctgatctcggctcactgcagcctctgccttccgagttccagcaattctcctgcctcagccttccaggtagctgggattacaggcacgtgccaccatgcctggctaatttttatatttttagtagagatggggtttcaccatgttggccaggctggtctggaactcctgattaggtgatccacccgcctctgcctcccaaagtgctaggattacaggcatgagccaccacacctggcctgggttgctttttaaattcatacctactgtcttatttgggtctcaaatgtgatcagtggttatacttttcttgctatgcatttaagttggagcaggctccggggcaccacttccctccctagagttgatgaacccctcatatcagtgacctccccatgtcacagtgtatctcgtgtgcactgctagatattctgatcacacagtgctgagattactggtttctctccctttctctttctgtggttatagggattctttaagggcaggcaacatgttctttgtttccataggatctgacaaagtgcatggcataggtaggtgttcatcaaaaggggtggaatagggttgatctcaagggttttaagagagatctgacgagtttgggtgtgtgacttaaaaagcagatacagcgccttttcacggatacacctccgtgattcctcaagtggtctggctgtgtttattttaggattctaaaagtaaagtgttctgttctgagtctttcacgatctgatgttctccagttctgtgaggtctcctcctttagtcccatcattggggctgtttctgctcggaaggccaggaagttgctggaagtctgctgggctttgcaaagggacttttgcttgtgtgggcattgcccagttgtgttacaacttgtttacagccgttggtttttaagggatgaggtaatcttagctcagcttagtgtaatacacaacagttttgtttattgagaaaatcattgttgaagtttttcagatgttagagatgttatgaattgcaatcaagtcggtatcctcttatataagtgcatctgacaagcccatttcacaactacatctcatcagtcacagttggatggcaaggtttattgtttaaagtttttgttttttcttttttaagttgggaaaggaagacagatggtttcagaagccaagaaagggcacaaaggcgtggatatttggaaatcgggacataattcaccattcttcttaattttttctgatctctaagacactgagacagctgttaattgaattgcttgttcacagtatttgagacgtaatgaaatgtgagtgtcctaatcacctggcgggcgtagatctttgggatcctcctggaggcttagtagggctgccctgagcagtattgtcttctccagctgggcctctgagctgtaccatgtgcccgtgctcagcctcagtccctccctcagccagttgttaaatcactttggacgtgtgacagcctcaacatgtcacagctttaaaagttcagattttaaaaaggtaaggaaatgatctcctagtgagacaacttctgcctaaaaaataaaagcttctaagacataaattctgtgttatgaacaacttgcaattttcatagttttcagttttagctctggcagcctctgatagatcttaaatatgtttatcacagctggaaaaatgttttattgtcatctttgtttatcataatatgccacctactctggttgtgtcttacaactgtagctctgtggggttttttttgtttgttttatgcttgctaatgggggaggtggggggtgggggcggatgaatataaatgatacctagaaattgaaattggaaaaaaaaatgtattcagccagtactctttccaggttatagctaaacgtcagttggcaacctctatgctgtggtttattgagtaacacttaatacttagcacagccctcagtgaagatcttttatggccttttctgaatgttatacaaacataactaaagcttatccagatgaggacagggacctttctttccttcctttttaaatggagcaaaatttggccactgggttgctgtggatgagagagtagaaggagaaaggcagtcatcgggagactgtgtgctgagagagcgcatgtgggatttggcttcaggaagtctgggcttgcattctatccagcgctaatatttagtgagtgtgatttggggcaaattatttcgtctccctgagcttcagaatgtttgaaactttgtgaggagtctgaccccacactgtaggctccctccatgtatatatttcttcttccttttcctttttttttttttttttttttaaatttttgagatagtgtctcgctctgtaaccccagttggaatgcagtggcatggtcatggcttactgcagcctcaacgtcccaggctcaagggatcctcctgcctcagcctcctgagtagctggggtcacagatgtgtgccatcacgcctggctaatttttaacattttttgtagagatgggagtctcactatgttgcccaggctgcactcaaactcctggactcaagcagtcctctccctccagcctcccaaagttctgggattacaggcatgagccaccatgcccggctggaactgttggctttgaagaagaatgatgctgtgcttgcctttgcagtcctgtcaccatacttcctggaaagtgggtggacacgctggatggtagatgttgagttctttagatgcctggatgcttacatgctttgtgtgggttcttactggggctgtaacttactagaggacagactccaacttctgcttacttagtctggggaggttaataataatctagggcacccgcttcccagtgggtttccatcagtctcctccagcccactctactctctgttagccagctgggcacctcttcctctgtgtcccttcggtatcttcccagtggctctttccacgactggctcagaccatgtgtatatctgctcattgtctgtccagggtccctccaaagatgcctctgtgggctgggcccctggtggtgcttcctccagataattgttgaagatggaacaggagtgtgcaagaacaccagcgtgcttccagtattcaggtctagcggcaggtcccaggcatcagcggctcaccactccaccgcaggtagcctgattgcccagccttggagccgcagcctccttgggtggtgtggcagctgtcagtgtctgaaaccattttgaactttaaagggtggtgtcagacagcagctattgaggctacttaaaagaatttttttaaatgtacgagttcagtggcattaagtacattcatattgttgtgcaaccatcaccactgtccatctccagaacttgttcatcttcccaaactgaaactccatgtccatcaaacaactccccattgcctttttccccaagtctttggcaaccgccattccactttctgtctgtaaatttgactgtctggatacctcatgtaagtggactcgtacactatttgtccttttgtgactggcccattttatgagcataatgtcctcaaggttcattcaggctgtagcatgtgtccagaatctccttcctttttaaggcccaataatatttaataatatatgtatgtgtgataacacatttatataatgtccattaccatgtggtatatatgcttatccatttgtctgtcgatggacacttgagttgctcccccgctttggctactgtgaataatatgactgtgatcatggatatgcaaatatttccttaagtctttcagttcttttgggtatatacccagaagtggaattgctggatcatatggcagttctatttttaattttttgaggaaccactgtactgttttccatgtagactgcataagaattccaatttttccacatcttgccaacgtttatttttatttatttctttaaattttttatagtagctatccattctaatggatgtgaggtggtatctcattatggttttgatgggacttttgagttttagcaaatatcaatgaagtatttaattttttttttttttcttagagacaggatctcacattgttgtccaggctagagtgcagtgatgtgagcatagttcactgcagcctcaacctcctaggctcatgtgatgctcccacctacgcttcctcaatagatgggactatgttcctgcgccatcactcctggtgaatttttaaatttttgtagagatgcggtcttggtacattttctaggctggtctggaagtcctggcctcaagcagttcttccacctgaacctcccaaagtgctgggattataggcgtgagccactgcacctggcttatttaaatttttatgggtatgaattcacttaaaagctgaaggttttgagaggagagggagcatatgaaaaaacctaaaggttttgggaggaggaggagaaggaagagagggagcatgtgaacaagagcaactgattacttccttgtcattcatttgcccagtgtttactaagcacctgctgtgtctcagacctgtgctggtttggcccttgtgaaggacagtaaatacagtgcagttccagctgcgcatgggatcacagtccagtaggtaaacgagtgcctaaacttaagagaaatgagtgcagttggggtcctgtggcggtgaaggggcgagtctgcacccaggcgagtgttaaaggcctggcctagagaagatgggtgttttgatggaaggagctgctgggaagcatgtgtactcggtgtcttggagtttagaaacctcagttggctccatgtctcgtccttagtaaaggaatatcgggagctgagactggatgtattgacacaggtcaaatcacagagtcttaggccatttcaaggaggttggatttttctctggaaggcacagggaggttttgaaggacttaatgcagaagaatgggcactgtcaggtttgtggtttggaaagtccgccttggtagtagggtggagggtgcattatggagggctagaccagggtccagcccccagcgagatgctgtgtggtaaccaggggagagagaggtggtggtgttagaagccacgacttggcatagaagccaaagcatccccaggttgtcattgtgtaattaatggttaagttggggcaagaaataaagctcttaaaagtgtccagctgtagagctctctgcctgtttttatcttcagatttttgtctttgccatctctggcctccagtggaaggccgaagttacttaacttccttgctggaagcagggctcctcatgattgccagcccctgtttggtagtggtcctggagtgctgtggaaatgggatacttggtgccacttaccttggggctttgctcctgaactgcagcggtgtcttgtgctctgtggtttgtagcatggaacagaggctgatgggcggggagtttgagtcccagtgattgaggccccctgcctgcctgcaccttactgaaggaaggacatggtggcttctcagtgtgctctctggtgatctgaacctagattcttgtttcacgggtagggggcagggttttggattcagccctggccagccctggcccaagttcatagtgtcagtagtatagttctcccaccacccccttctctcctgctcctgttttctcccccgccccttctctcctactctccttcctctcccactctccctcctctctctgcctttcacttccccccacactctctctcccccgctcccaactttctttctctcttcgactcaccacacaacacacacctgtgtgtgtgtgtgtgtgtgtgtgtgtgtgtgtgtgtgatggcactgttatttcatgtgtatacctttgcgtagcgttggcacatgtgggaatgctattataatgctttcgttgggggtctgtgctaaccactgctgagtgtgcttcatgttttctagacagcatgagaccagagctctccaccttgccattagctggtgggagaattttgagaaagtcacccaattgctcttaagtcctcatttttttttttaaatctgtaaaatggtatcacagatgcttatagctcaagactagttgatgagggtctgtgactcaaaaggccccatagatggggttcagagggcctttggaaatggcgtgcaagctctttgtaagtgtattttttttggagaaagggcccagctttttatcagacatcctgagagattcaggacctaaaaaataaaccttgattaatcttggaagcctctttttacgcagtacgctttgattcatcagtatatgcatgtggatgggttctcagatggcctgatgtttctcctccttcctctgtgtggtgggcgacgactttggctgcccagatgttaacatcagtaagcagaagctcagtcagtgttagcaaaattaaatcactctgcaaaaatcaatgttagtgaaattaaatcacttgatcttaaaagcagcatgaaatagcagtttttcatcttcattgtgctgttttcccactctagatatcttgcagattttttttggttgcttggttggttggtttttggcgtccttttcaaggacaagcagctttggacagttgcactacttttttttttttttttttttttttgacagagtcttgctctgtcacccaggctggggtgcagtggcgtgatctcagctcactgcaacctctgcctcccaggttcaagcagttctcctgcctcagcctcccaagtagctgggattacaggtgtctgccaccacactcggctaatttttatatttttagtagggacaaagtttcatcatgttattcaaattcctgacctcaagccatctgcctgccttggcctcccaaagtgctgggattacaggcgtgagtcactgtgctcagccagttgcactacattttttttttagatgccattgttgaggatccaggggtttgtcatagattgattaatcagaaagtattaatctaaagtattagaatatattgattgcaggcagggaccttgcatagtttaaagatgactcagaaggcacattaggttcttgccacactttgctgccatcacagatggatgtgagttgcccccttatataggtctctcgggatgccccagtggagaacagcattgatgttgaacagatcctgtccgatggagagataccagcgtttcagccagcggtgtgagtgagggcaggggccacctctgagggtgcttgctccctcacactgtcctcacgctgccctcaagctgtgggcaaaggagagggatcctgtgccatcacagccctagaagcagaattccaaaatgtgggctcctttgggtgtggtttgggggtcaaggagatagagcaagtaaggaatgaactttgagggtttatgatcattttcatgatgataatgacctaaaaacatgcttggctgggcatggtggctcatgcctataattccagcactttgggagactaagacaggaggatttcttgagtccaggagttcaagaccagcctggacaacatagggacaccccatctctacaaaaaaattaaaaaattagccaagcatggtggtgtgcacctgtagtcccagctactcaggaggctgaggcaggaggatcccttgagcctaagaggtcaaggctgcagtgagccatgtctgtgccactgtactccaacttgggtgacagagcaagactatcccaaaacaaaaacaaaaacacatgcttatggtaggcaattaaaacaggaggtaaggagtaaacatgccaggcccctcctcctctcctctgactcttccttcttcccccctgcttcccaagggtaagctttgcagatacttgctatgcaagcaaaaatgctattcttagccatcgtttaaacacagatttgcaatttgtggtttttcatttatataaattttggctctcttcctatagcagaatgatctttgtttttaaaatgattttaagtatacaattaatatgtgaatgtatgtttcttatggaaattagaacaatacacagttacagagtagaaggtgataggtgatatagctcaccctctcctcttcctgctactctccccagtctgcttcactccccggaaggaactactggcccatcagcatgtctccttccaggcattttttccatgtggttatgtccacctgcataagaaactgggggcggcagggtggggcggtgttggcgggtcaggcagaagcaagccacagagcagtaagggtactttttaaaaaaacatttaaatagatccctgttgtcctgcggcttacatgctcatgcatactcactgtttctttaaataaactttttcttttagaatagttttagatttacagaaaagttgccgcgatagtctagagagatcccatgtacctcttaacagcttcgcctctgttaacattctgtgtcaccatggtaatttgccacagctaaggaaccagcattagtccatgactgtcagtgaactaaactcaagactttttttggattttaccagttttgcccaatgttcctttcctggtctaggatcctgtgcagaatagcgcatcacagcacattacatttagctgtctccttcacctcttctggtctgtgacagggtctcagactttccttgtccttggtgactttgacagtttcgagggacactggccaggttttgtgcacactgccccttaatttggagttgtctcatggttttttttgtttttttttttttttgagacagagtctcactcgtctcccaagctggagtgcaatggtgcaacctcgactcactgcaacttctgcctcccaggttcaagcaattctcctgcttcagcctcccgagtagctgggattacaggtgcctgccaccacacccaactaatttttgtatttttagtaaagatggggtttcaccaggttgggcaggctggtctcgaactcctgacctcgggtgattgcccacctcggcctcccaaagtgctaagattacaggtgtgagccaccctgcccggcccatggttttcttatgggtagtctgggaccatgggtttttgggagcaagaccacagagctgaaatgccctcccttcagtgatttgtcagcatgacctatcaccattgttgttaaccttcaccacctggatgaggcagtgtatgcgtggggacatacatctatttgccccactgacatgagggttggatctctagaagaggagtcactgttcagaggttataggcatttgtattttttggcagatgttgtccttcaaaatggctgtacacatatgctcctcccaaaagtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagatcacttgagctcaggagttcaagatcagcctgggcaacatggtgaaaccccatctctaccaaaaatacaaaaaaattagctgggcatggtggtgcttgcttttggtcccagctacttgggaggctgatgtgggagtatcacttgagcccaggaagttgaggctacagtgagccgagatcgtgccactgccctctagcctgggtgacagtgtgagaccctggctccaaagaaaaaaagaagattgattgagatagggtcttgctctgttcaggctggaatgcagtggtgtcatcatcatagtttactgtagccttgaactcttgggctcaagcagtcctgctcctttggcctcccaaagtgctggggttacaggcatgagccactatgctcagccaagctaaaaatatcttagtgtgcatttctctaattgtcagaagtgtatttatttaccataccctggaaaccttatgtaagatgatggtgagtttggactttccagtaacatttggaaactgtttagtaccaagctctcattaacaatataaacaaaataggggtctacccttaaggaatcaaagccattatctaaaagctctttcccgcaacaactacctgagataatgtccttggtcatatgccccagcatttaaaaatggagttagtgagagtctgttgtttaccacctgatacattggtaagagctgcttgatggtatggggacatcagtagggaggatatagacgtagccacccccgccctagatagtaggggcctcagggtggggtaagcctgggtgggggaggtatgagtggtggaacagtgggagaccctggatccttagtctccagcgtgattgcattttgccaaggctttgtcccatgtccctttgtcccgtgttccatttgcccgtggtgttgcctagagagcatggaggggctggtggagcatgctctgtggttccctaacccagggctgtgtggggagagcttgcagcacccccctgaccccatatgaacgtccttgctatttcctgctgtgccatccagcaactataggatgctgtgctgtggctgggagacctgtttggtcttggaagctgggtcctggatgagcagaatgaggcaggcatagaggtgatgttggctacgggcaggggagcatttgctttgccttggagtagtgccatttccatgtagaggggcaagatttaccaccctgttgtggggatttgagactttgggttttgttttcctttacaccttgagctttgttctacagcaggtccctgggaagactggtccacaaagctgctgaatggggctgctgtccttcagccctgcctcctgctgcagaatgcagaggacgctgtagacttgcttggtgggtgcctggggttttctgcctccctggtgcactgggcacagcggcttgcctgccttttgggtcgtctccacctcccagggatgtttttgttccctgatcgaatgacctcctgttttgtttgttttttgagacggagttttgctttgtcacccaggctggagtgcaatggcatgatctcggctaactgcaacctctgcctcccgggttcaagtgattcttgtgcttcagccttctgagtagctgggacttcaggtgtatgccaccatgccacgctcatttttgtatttttagtagagatggggttttaccatgttggtcaggctggtctcgaactcctggcctcaagcagtgcgcctgcctcagcctcccaaagtgctgggattacaggcgtgagccaccgtgcctggcctgacctcctgtcttctgtttttgcccactgtcaagggtagacttcttcaaggctgtacttgtgctatcctaaagaggagtaatgggagacatttctgactttgtcagcatgctgcttggcagcacctgcctcgtttctggtgaccatttggaaatgtgtcctttatctggtagcaaggagcatttacattgatccctatgcacttaattggcatacttttattcctctggattttttttttaaagcataattgttcgtgtctacatgatgtaacatgctgctgacttttaagcaaattaacagagttcgtgctgaagcgcaagggtgcagggaaacaaaatgggagggttattaaaggggtgaggcggctcctcaaagatgtcactgcaccattcattcttgtgttcctggcccatggcaggctcattaatcctccacgacaatccattagcatgcctgtcaacccttcagagaagatgagccataggaaggcttagggatccccacttgaactgctgtgtggctctatgaacatccccaccttcctggagtgaggtggttgtggccacctgactttccccattttttttttttggacctcagcctccagcgctcctgggccagactcagggtgggggggatgcaggtgccagtgactgacacttggcccctcacacttcactgcctgatttgctttaaaggcaagggttgctcatgcttgtctgagctctccatctgtttgagaattatattgttctcaactggaacttgtaaaagagaaaaaaatgtacttctcaatttccatggaagaatatagattttctggtggggtggaaactttcttagcatgaagggatctttgtgtgatctgcgcatcagcactgaataaagaatgggtgcgccgaagtcggggaggccgactttcctgtggcttgctggggaaagtttgaactgtgtgtaagcagtgcgtggaaggaaagctaagtgtggagataacgaagggaatgggatttaatagaaacagggtgtgatgagtggcagttgcctgatgaagtggaaatcttgtgttccaaatttgtgagatccatttctgtcctctaaggaaaatgttgtatgtgcaggaggagttcatgtagttgggttagattgtgttttctgtctttattttttttcctgcctctatgggttgtgaacaaaaacaagaatttgatattctgcagtatagttaactcgtgcaaacagtgtatgcttttcagtgggatataaggtctgaaataataggattttccctagtaagtcagtttcattcctttacatgtgggttatgagatacaaagtgaagctctgtaaagctttttacgagctccctgtgttgccctcctttgacgggtcaaggcattggggttgacagaggtttctactctcagaggctttaaagaggtgcccactctggtgagatggctgtcagcatgcacgatgtgtgtgagagagcacctcttcaatcatatgcacctggctgtagcatccttgtcagccttaagagatacctccaaagcggaattttctacccctagaatcatgtgaggtcatctcaatttaagccccagctctgctccctaaattacctgagtgatcccaggtaggtcatttgctcattgttaaccatcagtttccttagctgcaaaacagagcagataacaccccaaaagagttctcatagtaaatcacatcaggcttacacaatctcagaaatgtgcagctccacaggaatcttcattacctctttaggcagtccagtcgggtttcaaatgaatcctactgtctgttcttatatggaaccacagtccctcaccctgtgttgatctaagttctctgtttctctcctccagcagggtcataaagagcctgaccagtccccctccctggagacctttgtgtgctgggtttctgcagccgttctccatgagaagggacttctggtccctgctctcacttggatgttcttccactgacttatctctcttaatgtgtggaggcagaaacccagttttcagggtctctcccctggccccttactaagtctcccttaggtacagtctaagactgcctgactttttcttctttttttttttttttttggcagccacaacatcacatcgtcacatacagaaattatatccaattaaatctcctaagtctttttcacacctcctacatttgtgcatttctttttttgcacccaagtgtccaaatagcatttatttcctctctattgcaattccaatctgttgatctttttagctcttgactctgtcatccagtgtatttgccattgctcctggaaacttgtcatctttgaattagataaacattttatctgtgccatcgttcaagtaattgataaaaatgttgaaatctacagtactcagaaagagacctgtggcctcccactagagaccttccttggtctgttcattaatcagcactttgtagggtaaattgaacatttactaagctattcagatgtagttcatatttcttcaccttgtcaacaaagagatcttagcaaggcattgtagaccaagtatgtgttcctggaatatacatattaagaaaaaatccttatgccaagaaaatgggcacatccccaaaacccaggttattgtagtttacggcttctgacccagggcttcactttgtagcagtgtttttcttctgtttttgcctttggctgataccactgctagagtgcagataagagaatgttactaccagggggcttgagtgtcgggctatgattggctgtcatctggagcagagtgggactgagctgctcaggagaaaggtcttcaggtgattttttttgggaagctaagagcactggttttagacatcctctcctggctgatgatgggattggccttcatggggctgctgtctggctgggctggtgggcagaggttcctgtgggtgtggatggagaaatcctaaatgccgagggtacctggtcttagtagaaatcgtaggatgcctcagtgaagaagtcagggatgcggattgtcctccggatgcttggatgagcgtgcagtggaaaaagtactcctttgggggaagaggtgaatctggaggtgttagagcagaagagtaaatgcagaagttgtagcagatacaaaggctttggcaagagtgggagtgatcattgaagggaaggcaggggcttgctgggacaggctggagccgtgatggaccctcatagtaaccctgctgcattttacaaaggaagaactgtgttggggtacagatgtgccaaacactcaaagttagaaaatcaacgcagtcggttgtggcttctgcccttgaaacatcagatagtgagaacctgccactgttcagtttgcagagtggttggttgcatacagtgttttagctcttgcccactcaatacagaggttgcatgcgggcgtccacctgctccgccacctctgcctgcttgtggctgtgtgcccagagcccatttccctggggagtcagtgcagcactcctgggggacccttctgtttgtgtcctgacgaatctgactgtgctggatgcagtcccacagccacacctggtatgggtggcatctttaaaggcctggcctgtgtgtgctgtatctgcagcagagctgtggccaaacctgctttccttccatctgggttccccttggttctcggtggtggacgggctgtgtggtctcccctcagctgtccacttgcacttgtgttaaaatgcggcagaactttccctctatacttaaattgtggtgaaatacgtatgacataaaacttaccatcttaacttttttttattgagacaggttctcattctgtcacccaggctggagtttttttattgagacaggatctcattctgtcacccaggctggagtgcggtggcgcgatctctgctcactgcaacctctgcctcctgggttcaggcgattctcatgcctcagccacccgagtagctggaattacacgcgcccgccaccatgcctggctaacttttgtattgttagagatggggtttcgccatgttggccaggccggtcttgaattcctggcctcaagtgatccccctgcttcggcctcccgaagtgctgagattacaggcgtgagccgccgcgcctggccttccttttttttttttttttaagagatggagtcttgctctgtcgcccaggctggagtgccgtggtgcgatcttggctcactgcaacctctgcctcccaggttgaagtgattcttctgcctcagcctcccgagtacctgggattacaggcgccaggcaccatgcctggctaatttttgtatttttagtggagatggggtttcaccatgttggccaggctggtcttgaactcctgacctcgtgatccgcctgcctcggcctcccaaagtgctgggatcacaggtgtgagccaccacgcccaccggcctcccatcttaacattttaaagtgttcagtttaagtacctttacactgctgtccaatcaatctctagaacacttttcatcttgaaaaacggaaactctgtacccattaataactcccattctctcctaccacagccacgggcagccactttctgctgtctccgtgagtctgactactttgagtacctatgagcagaatccgcaggatttctccttttgtgactgccttatttcacttagcataatgtcctcaagctccatccaggttgttgcatgtgagaggatttccttcctgtgcatgaactagagtgatgcagggactgacctctggccatgtgatgggtggttggtgatggatccaagaggtagctggtctctgaatactagcccagtccttttccttgctaggaaagtccccagatcagatagaaagcctcagtatttcaagaagcttctgttttgacaccacatccatgaagaatcacactgcagggtaggggaacagatgagtgggatttctacactgttatcagctagacttagataactggctaattgaaaagagtacaggtcacttaaggaaactggagcattgtagggcaaggtaaagtgcttttgaaatgaggatgtgaactgtaactggaatgatgtaatgtgttctacaaaatgaagccagtgagaggacaggggacacagggccgacttttatttaggacatttgcctggttctgagaagaaagttgaaagtcacgagagagagggaaaggaaggcagaaggaacttggtttttgcaggtgcctgctcagcatgggccttgccccagcttggctgtacctcacagcaccatccactggctctacagtctgtccttcggaggtttagggtgctgtctcatgcacagtgggtgctaggtggtagtgaggacagggtgtgggactaggcaggtgctgcccctcggaaggcctcatggtgaggcaaagatctctggctccgagggactctatctcctggtgtcctgcttcatcgagaagccagccacccatgggaactgtggataattagaaaggcttagaggctcttctaagggtgttttttgaaatatggagacctagaatattgggctttgggatattttaagatgagaaaggcatttggagtaactgtcagagcagataaagttgtttttatgaagatccgggaaaacggttgttacaaatacagctctgcaccaattctgcgccagtctgtttggctacagatgctttcagtggaggggacactggggcttgtgttccctttagtctttgaattcccgttaaagtttccatgtcttaagtggcgtggcaggatagaaacatctcacccatcttagtaagttctttgctgtatgtagcactctggttttaacgttctgagccttcaggactgcccttgatgtgtgcatttattttgttgatatgcatgatgtgtgggtggctctgcggcagtaaaacagttcacattcaaattacactcggtttctaatttctgttctcagagtttcctctgtaatggaaatctcttacattcttatcattgccttcagttattgaatgtgttaggtggccaggattgctgtctgtgtgaaatgggaatgtatatatacaacgtaaacatgttctgattgacacgtgaagataaagggcttaacatgaattgtgtcggtttacacttacacagaaaattctactgtaataaactgaagtgtcagtagtgtttgttatcataacattgtctttttccctcttttctgatctctgatttttcaattaggaatgaggcctaaagaaacccatgctctctcttctctgagcgcaaggagggtgtgctgagaccttgaagggcacagcatgggaggatcatatactagggagagtctgtctccaccccatttttcttctgctttgctttgtttcgtagtttcttcgggcttcttgggggttttctgagagagagaatgtcaatttgagaagtaacaggtgcacaggctttacctgcaccacactgcagataaggtgggtagggagggtagtgacaggtggtgtggtgggttattcagttctttcctagggcagtgggtctcacagggtggtgcttaggccagcagcatcagcatcacctgggtgcatattagaaacaaattttggggcctcacctcttgcgttttaacagttccttcaagtggtcctgatgcatgttgaggactttgaacactcctcctacaagcaaagtgaagttgacctcccacacacttgtctcagtctgctttctagcatctgtcccattgcctttgttgttctccccgccacacgggctgcacccctgggattcccccagctgccaccaggcatcagctccagctgcctcccagggtgtgctcctgcctctgcttggagtaccctgcctcccactcttcctggcaagaccctgctcatctttcagggtcgtctctgctgagaagtcttcctgacctcctcggagatagggagttgtggggccttgtctttatgttcccagggttctgtctattgcgctattaaaactttttttttcatttaatttgccacttgctagagagatggttgttctgccttcgttgtgcaaaattcagtgatacactaatcctctcctaacctcttaaatcattttgactttcacagagtgatagtgtctagagagggtttttgttgtactaagttattggttccaaagaattcattttaagaggagtaaagaactattatagtatgccgcttactgagacaaaaccgacttctcacataagcccaaaggttttgttatgttggattttaccattagagttaaagatgatgattggttcactaatgtgctttaccttcacagtgtgcctgtagacctgtagtaaaagaaggctaattatgtttcctgatgtcttttatttccaactataagctaagcctatctcattttttttttttttttttttttttttttgagatggagtctcgttctgtcacccaggctggagtgcagtggcgtgatctcagctcactgcaagctccgcctcccgggttcatgccattctcctgcctcagcctcccaagtagctgggactacaggtgcccgccaccacacccggctaattttgtttttgtatttttagtagagatggggtttcaccgtgttagccaggatggtcttgatcttctgacccgtgatcctaccgcctcggcctcccacagtgctggtattacaggcatgagccgccgcacccggccaacctatcccatatttttaaagaagagttgatcaagtagttacccattttaactaaatggataactataacattctttaatggaattgttgacagagggataatcagtgtttttgctaattcatgccaccctcctttgttgtatgttagtaatatttacattggggcaacaaaatagatcagtatttccattaatgtttacttaataacagctgctaaaaggtattactgtttgcagtaacacaaaagcacttacctgattcttatgccagcttctatagggtaggtagtgacagcccattttgcaggtgaggaagatggggtttagaggtgaggtgtgtctgcctgagagcaggagctggtaaatggcactctgggctcatgggagtcacgctgtttttttttttttttttttttcctaggacctcaaggttgtgtctaagacataatttacagttctcgtgtaggtcttccaaatacttagctacacagctttggggcgttttctcagccaaatacttttctttagcccttctcatattaacatttagttcttagggatttattttcaaaatatatatagcttgtatatgccattcacctaagttgttagagcagacattctgcctcttgatctttagaaaatacctaagagtattttgttaacagtactcatttcagctgaaagactttattttaaaatttaatttaattttattattgttttttgagacagaatcttgctctgtgtctcccaggctggagtgcagtggtgtgatcttgacttgttgcaacgtctgccttgtgggttcaagtgattcttgggcctcagccacccaagtagctgggattacaggcgtgcaccaccacgcctggctaatttttgtatttttagtagagatggggtttcaaactcttggcctcaagcgatctacctgccttgggctaccagagtgctgggactgcaggcatgaaccactgtgcctgacttttaaggctttctttaaaatggcatcttttggccaggtgtggtggtaatcccagcacttctggaggctgaggctggaggattgcttgagcccaggaattggagaccaacctgggcaacatagggaaaccctctctctgccaaaaaattaaaaaacaaaacaaaacctaggtgttatggtgtacccctgtggtcccagctgcttgggagctgaggtggaaggattgcttgagcccaggaggtcgaggctgcattgagccacgattgtgctgcagcactctagcctgggtgacagagtgagaccacgtctcaaaaaacaataaaaaataaataaaatgacatctttggagaagtgaattctacccaggtaccaagcccctgcctgcccctcccaactcccttccctgactcccagcacccccatctgttttggttctgctgttgccattctctggctttggggactttgctgaggccccactgtccccatcttccagctgtaccctttctctctgcttccctgcttgtcttattctttacagggctgcctgggatctcacattccaaaagtttttgggtttgtttttggatcatgccaatatcggttgctttgagaagggagaaagggtattttgcattttccttttaatcatcggtgagtagccacaaagggtgtgtctctccctcttgtgctgtgtttactgtttactccctcggtgcatgaattatttcatggcaccagtggagcatattttcttctctttcctgtttgtggcttgcgcctcctgaacgctgctatcattcatggtccagcttggttttctttttcactgtttctatcacaaaacctcctgaagaccagtggtgtcagtcataggctccaaaacagctggttcctaggccctgcctcgtgctctgtggtttgggcttgtcttttcttccagagtaagtgggtagcttcttcctactttttttctcttttcttctataaatgggaggaaaagtgtgaagtatggagactgctctttcatttgaaggaaattcacagttccagctctgtagtgtggcctctgttaactagtggtcaacactgactgtggaaggggggccagatggcaaagtgaagcagattctttcctcctgtctgcattttgattgcagtatgaagttcaacttgcttcagtctttgtcttcatgttgtttcactaggtactgaattttgtgatctgttggaaataacaagtaaatagatgcctaacgctttatacaggttgagcctgtctaatccaaaaatccaaaatccagaatgcttcaaaagtttcagcttttggagcactgacatgacaccacaagtggaaaattccacacctgacctcatgtgacgggtcacttttcgaaactcaggcacacgacacacagttaatttagtgtccccaagggaaaaaaagaccctcccggcccccttcagctgtgatgtgtcttttccacacatgcccagattccctcagacacctccacaaagggtaataaaatggttcgttgtatacaaactttgtttcatgcacaagattattaaaaatatataaaatgactttttagagaagcgagaagagaaatgagaggtaggggagggagggaggagttgggggacagttgggggaatagttgaagctaaggtgtttaggcagagctctgaggaggtgacgtttgagtggagacccagatggctagagaatggggcagcctcctgaaggagcagaagcactgtgggcggcagggtatcacagaggaggagctcggtgtgttggaggttggtgagtcccgtggagtcttgtcagatggtgttgggacagggacggaccgtgaggaggctggatcatggggaatgtgttgctttaggccaagctggagttgatagtggctcagatcagagctaaagtagtggagacacacagacattgaaagaatgatgaaattcactcattctgcgtgtgtcccatgtcatgtgtccgctgcacaccaagtactgttttaggcactggtgatataattgtgaaccaactggagctgcggtgagagagaccatgaaaagaagggccagagcggtgtcctgcagagggtggtgtaccttgggagggaagtgtgtagggttgttgaggaacagtgtgctgcacagggaggaaagacgtggggcagcattgtgggaagagcaaccaagattctcataggcttgggagcggaagccctgaggtctgttgctggactagatatgtgaggtgtgagaggagagaagaatcaggaatgactctttgattcttaacgtgagcaactcagagaatgagagtgctgcagtttacaagcttggaaggtggattatgtggggggatgagtgagttgtttgacacctcaatggatatactcagatggatgtatacgttagagctcaaaagagtctgggccagtgacatgaatttgatcatatctagagtatgagtggcacaggaagccacttgtctggatgaggtgacagaggaaaaggttgaggatagcaaccaacatttagaggtaaggtagaaggcagagcagtgtggaatcagggaagccgagaggaggaggcaatgccaggtgactggaaggtcaagtgacacttcgacagtgtcactgagggctctgctaggagctattcggtgtcataatggggacagaagctcagtcggagtgggttaaaggtaaccaggaggtgagggtgctgagaggtgggactattgacaagccttgtgtcaagttttgctatgtaggggctgaaatctaatgtatgtgactgtgtataagtgacttgacttccccaaatctgtttcctcacctttaaaatgggtgtttgccaagtgctggtttctgctattcttttctctgtcttaggggtgtcattttctctttggtaaaacagaagaattagatgatatgaagtttcacattctaagttctcaagctttgcccactcctcagcccttgggtccctccacttcctcttctcttcgctatctctgctcagtttctgtctttgattgtaatgtaatgcccagtgggacttttcttctctccctcgtctgttcacttattccgtcctgcactgggccaccagattaatcctgcaaaaggcctcacatgggcttctctcctgctcaggagccttgtgggggctttattcctctgagatgaaagttcttatccccacatgtgatcctttatgacttgggtgctatcaaattcatttcctcaactgctcccctcttcaccctgaccatcagatctgctggcacatgggcataccttgttctgcattgtctctggcctgtgggatatttaccgagctttaaatcctaggcaccctttgggagccggcctgtgtgcagagctccccttagcacggtggcacaaagcttggacaccacctcttgtctgtcctgcttaattccattcacatctagagtggactcgctgtgtgcacaccactgaccacctgcctcatgtgacagttgttcctcatgggtcttagctctttgccttcaccatgagcctcctcagagggcagggcactgcctgttggcatttctcgtggtatcatacatgttgggtgcttcccaaattaattacatcagtcagaaaacttcactctatctgagaagctttaatagtgtacttgggattattaaatcctaaaaaaggttatcacaaagagttttcttggtgtgtgtctgtgcttagaatttagaaaataagtcatccagtattgaggccattttatgaaaagcctttaaaatctgcaaatgcgttggcccagcacttccacttctagggatttatcctaagaaaatagtcttgggtatctgccaataatgttcactggagtgttgtttataatgtgcaaaacaggagctaacctaaatgtccaacaataagggattggttaaaaaaaaaaaacaaccctcatggtgtgtattaatactctggaactactgtccccttaaaatggtgatgtagaaggacatgtattgacctagtaaaatattaagtgaaggaagtgtgtttacaaatgtcatttttgtctgatttcacttaccttcatttatagagagtggataattggcatagatagtgttaacattgtttatcgtggaatgttgagatcgttgatgatttttactggtttttttttttttggttattacctctaaactctgtaggaagcatgctttcttgatcaataaaacttaaagttggagtttatgctgcttttattcataaaaaaatcacgtttttaatcttctgttaggttatcctttatgtctacattaatgcacgtgtggagagaacacagtctactcggcttatgtcaaatggtagtgggaagcatggaagcatgcgttttttagtccccactttacaagtcacagtgacggttctccagtgtagagtagattgattgccctgtgtccttcaggcagggtgcagtagtaagttattgatacttggctgctgagctgtcgttcaggccttggcaactgacgctctgcagaacggaccaggagtgtgcggtggtggagtccggctggcctgggttgcagatttaactttcgcctctgcctctgtgtgcctctgggctgtaagctttagtttgcacggttaacggggatggcctctcccatggtcggttggagtgtgttgcacagcgtctggtccagtgttggcactgtataaatgccagctaactggttagccacctaaactgtcagtctgcaacccacagctctgcagtgaacaattgaacctcatttctttaataataatacaggattcctgaaaaccaactgtattattgtttggaaaatagtttaaaaattatttccttctaactgagacgtttaccctcttgtctcccttcagtctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaagtaagaatgatgctgactgctgctttctctctgcctctctctctcctctcctcctccttgacctcccttctcttctgagtgcacgagttccgctgggcagggtgcagtcgtgttgcatttaggacgtggcatgcctgctgtgcggaagtggttcccagtgggggtcttggttggctttcctttgcatctgggactcttggattgcgggactgtggcgtggctggaggccatcatggctgctgtcaagactgttcaaatcacatgttagaaataatccagcacactcctgggctagacacttgctgaccttcagctttgaattcctgatgagaaaggtgacctggtgtgcttggaagtccctgagccttggcagctgggggctgcttatgtgtcagctctttcatcctttgtgcgaagtgatattttttgttctgcaggacttccttagtttgaatggacttggaatatggttaaataaagggaaggtaaagcactaactcatatcctgtgaaagtggtccttaggtcctagtgatgatgttatgatactcaggtgtcctggttatgacagagcacctggcccaggtgggagacctctggacccatttctgcaagtcccaggttcaggctgtacttgcaggtagctgtgtagcagggtgcatttttaaacctctgggattctgttttcgttcttttatacctgtttactgaacagttgtgaaaatcttaagatttcacgagtgaaggaactttggaaagtatttactgttctgggggtcagatggtggtattttgaagcttcttgtatatttatctgcaatatgcttattttcccttgagaataactgagctcttgccttcatgtgatcagttccttaagaaccaggctgtttggtattaaaatgtgactctgagccttcaccttattgcattcagcaatagttatgtatattggctaggaagcttttcctcactggtttgaagtcagtgtgttagctataaatagctattatttaagtgttggcccagttaaagatgtaaggaacccatgttctctagttatgaagaaccaagaaaccccaaattgttagacttgcctaaaataaataaaaggcgagaccccacaggggtgaagtgtgtaaagtaaataaaggacagacctcccaggtagcccttcagttcccgttcaaccagtcctgaggcaggaaaaggatctgtgtaccctgatctgccacgcacttttctattctgcagaattggatcagtgcgtatgtgaacattgattagtgagggcaggggtcccactggctgcagccagtaccttgtagagctctgagaatgcagtcaggccactttaaggttggctggagttggagggagatcttatgctaaagtcacttgtgtggttgattaaaactgccctatcattaagttacccactggtttgagaaaacaacaaaatatattttttaaataaccttgacatttaaaaattttatctgaaaagtaaaaggtgttatcaagggaggcagcatggagtagaaaagagatgttgaatgtggtgatgagggccaggaatgaccttggatgggccagcccttctgggctgtagttgggcttttttaggatatttctagggcagtccagtacatcccttagtggtgatcatatatgggcatgaggatgttttgaaaactcataagctctttagagaagggaggtgccatatgaaacgtcattaagtggagagttgttcacgaactaggtaggtagttactttggtcttgccataggtttttggctgtttctgatgagctactgattgaagacccctggggtaggggtgaggcctgcattctgggtccaagtctaagagtggcgactagaaatgagcaagttatttaaattgcctgggccttggtttcttcatatgtggaatggggtaaagcctgccttcctcatagggctgttggaagatgaaaaggaggaaggaaaagcaccgtgaaaatgttaacgatggttagaaggtgggctctgctggtgacagacagagccttgatatcacctgttggttggtcacctgcttccccaaggccacgccctgcagccttctccttgaccatcccagccctgctgatgttccttgtgatttcacaatggagtacttatataaaattggtaactgctttccgggaaattgacttcccttccccttgtcctgaaaactcaggcatgggcatatttcttggagattttctagttgaatcagaacttcctcttggtttgcgtagattccatttagacctgcattgtccagtgtggtagccgcttattgagtaagccacgtggcttattgagtacttgaactgtggcttgtccgaattgggactgctttaggtgtaaaatatacactagatttccaagacatagtatagcaaaaactctgtacaccatttcattaataattactatgttgataacatgttgaaatataacattttggatatattagattaagtaaaatgtgttcttaaatttcacctgcctgtttcctttttattcttttttttttttttttgaggcggagtttcgctctcatcacccaggctggagtgcagcggcgcgatctcagctcactgcaacctccgtctcctgggttcaagcgattctcttgcctcagcctcccaagtagctggaattacaagcatgtgccaccatgcccgtctaatttttgtattttaactggagacggggtttcaccaccatgttggccaggctggtctcaaactcctgacctcagatgatccgcccgcctcagcctcccaaagtgttaggattacaggtgtgagccaccatgcccgactctttttaattcttaatgtggctacttgaaaatttaaaattacagatgtggcttgcattctgtgttggtaagctgctttagagcatttcttttaacaccaggagttcttcccctcatcatctttttggctgagtcgtcactgcagcgctcatagccccgcatgtacctctccagccagaacccttaggaatcatttggggagctccatgaagggcattgagtccaggcagaatggctaccttgagttcaacataagcattaagatggccattcgaaaacattaagcacagaagaatcccattcaggtaatcttctgttggctggctgtagaactacggagaacatctggagaaacacgtcaagggtgtgtgtgaaatcgttgagcctactcgattttgtcgtgctgttgcgcggttttcacttggcactgtcctttaaactccttctgtgccgtgactctgcagtgtctggcagcgtagtagactctactccctctatggacgtgatccctctgtgggttctctgcacacttctgtatttctcggttctttttggatttaggagtggattttatacatttttgagtcattcctaaagagcgattgacccttaaagaactgtgtacagtggtttcctttcagtaagaacatagttgtgtggcaccccctgacatgtggtgtggttgattcttcttccttgtcttccaacgccaccctcttatgagtctcttcctacccccacaggtgccgcttctctgtctcccttccctcagtctggcttttaacggtggtctcctgacatagtccattcaggctgctgtaacaaaatcccataccctgagtggcttacacacaacagaaatactgctcacagttctggaggctggaagtccaagttcaaggtgcttaccagattaactgtctggggagggcccacactctggttcacagaagcaccttttcactgtcttcacatgttggaaggggcgagggattttttttctggcgtcttttttataagggcactaatcccatttgtgagggctccaccctcatggcctaatcacctcccagagccatcatactggggattaggtttcaacataagaattttgaggggacataaacattcagatcatagcatggctggagttctgtcctgggctctcttttcactttccttgttctcatctcatccactggtaactgcattgcctcctgtctccacctaaacttccaagtatctccagcccagaacccttttgagtccaggacctgtcattcatatccatcccagaacccttttgaacccaggacttgtcattcatatcagaccaccacgagcatttcactacagcctctgatggtcttccctgtttcctcacttttgcctattttttttcttttctattccctcttaagtgggccacacttttgttcccctggttcttatgtcaggaatgtgggtgtcctttggacacttccttctccagttggataccaggccctttccctcccgaatggaatggaaatgctgcttcagctgtgttcctctgctcctcccccttacagcagtgacatagcctctctcctgctattgtgtcctgtggctccaccgagcactggggagcttttcagtatgcacttttttttttttggagaaagagtcttactctgtcacccaggctggagtgcagtggtgcgatcttggctcattgcaacctccgggctcccaggttcaagtgattctactgcctcagccgcctgagtagctgggattacaggcccgcaccaccacacccagctaatttttgtatttttagtagagacggggtttcaccatgttaaccaggctggtctcgaactcccgacctcaggcgatccaccggtcttggcctcccaatgtgctgggattacaggcatgagccactgcgcccggccatctagtgtgcactttggactgatgagctcccctacctgaaatcctgtagcaagtccctataggataggcatgtggtacagtgtgaagctcctgagtggtcaacagctaccccgtgacaacatgccacactccatgtgccactccctcccgcctgcctgctgtgtccttggccccagtggtgctctcccgtgctgaccagccggcacggctcacctggccgaactctagccttgccttttcctctcaaggatgtaaaggctctgcagatttcgggaggcctgtctcccagcacctgatgggacactttttgccccactgtaaattctgggtgtatcctccactgtatgctgtcaccccaagggcaagcactgcatctgcttagtgaaggatttattgttcggaagatacattttccccttgagcagagagtggcgtatcctggcagtcttcggtgagccagttgtaccaggattatgaaatgcagatgtttactgtgtcattgttgctgtcattgctactgaggagtactgaccagaatcatctgcaactcttagttggcagagaggaccactatggcgggtagctcttttctttcctgccattgtggggatgattccaggccaaagatgatggagaagtatggaaatcatctgaaaggttgaagcttggcacgtgaagccattcatgactttgtaaggcagttttgctgaaggccagttctgccctgggagggacggaggtgaatcctcctgagtacctgtggttttcttacttcctgctgaatttacctaagtgcctgttgtttgcttgctgtggaggctttctggtatttcatttcaggtgcagatgccttcactttcccacaaaaaaaaccccaacaaaacctaagaccttactgcaactaagtctccaagtactttttaacccattgggatgaacagcctgtggtctgctcagatcaccctgagtgcgtgtgagaaggcctgggctttgccaggaaatccaggaaggcagggccgggctgtgttggaagctggcttagctggtggggcagccttatttcaattaaaagggcattgactgggagcagcagtcctggagtttgttgcatttcctattgccctcaaaatgagaaaccaggaaaatagcagattggagccttcgagaaggcagtaaatggctgtttttattgacaaaaggaaaacattttactgccatctcactgatggcatctcactgacttaaaatgaaggcaggttgtagtaaaaaaaaaaaagtctacatttttccaccgccacgttcttatatccttgtttgtcagccactgctcacaagggcagtgttgtcttgcggagtagaggcgctctccttccctcgttttcctctataggttggtgtggctgacctgctagatcaaagtggaggacctgtttaagaatgtgtaaattgaaggctgggcgcagtggctaacacctgtaatcctagcatttggggaggctgaggcaggaggatcgcttgagtccaggagctcaagactggcctgggcaacatggtgagaccttgttcatataaaaaaatttaaataattagctggttgtggaggcacgtgcctatagtcccagcactttgggaggctgagatgggaggatccgcctgagcctggggagatggaggttacagtgagccgtggttgtgccactgcacttcagcctgggcgacataatgaaatcctgtctgagaaaaaaaaaaaaagattttgtaactaagttttatggctagctttgagaaaggaaaataataataaaaaaagaatgtgtaaatcacctgctggatggggggaagaggggcacattgtctttgtagtgagacttcactcatgtgatgtgcagtatttcatcttaacattttttttttaaacttaagctacttgtgaagagctgagatgtttctgttaagcactgtgtggtctgctgctggtcttctgcaggccactgttccccagactgctaagacgatcatgacacaggcttgcattttcaggtggactcttgggaggggcttgtggaccctggaggagaaggcagccaggagaggggcatctggctttgtgttgttggtaggaacttgtctcggttgccctggaaggcctctgctctggtcagctgctcccagtgtgggggtgatctttatttagaagggggtcacatgcccccaggcctcattgctatgccttttatagtcaggcgtggagctcacattctcttctgcctgattgccgacgcttgttgccgagatggtgaagcagtttgtgtgcaggttccctgggacctggcttagcccacctcatttcttggggcgtgtgccttgtgcctcaaagactttgcttttggctaattgtcattagtgatggtgtcaccatcctgggcctccttcagaagtttttaatagggatctcgtctaagagaccaaaaagctttcagaaccactgacttgtggtgatttttgcatgccaagtatttggaaaatatctggagccccttcagctctcaccagttaaacctatttgtacatttgttctggtttcttcctgtgcttgaaaagcctctttctttgttgcgttaatacctctgtcttgctttcctcatgtgtatgccagtgtgacattctcggcagagtggggatgacgtggagcgtgtgggcccgtggttaatcttgtcctgaattgccttgctcaacttgcgtgtatagggtggttcaaaagttaagtttggctggtggtgaagttggaagcatcacttagaaacacgcctcctttgggcatatggtgtgaatcagggactctggctataaaaggtggggtctctgagcaccatcctggttggaatgttcccctgacttggaggtagcgagagacagccaaggtgtttgttccagggaggctggtgggtgggagatgggatttttctgtctgtggcacaggcagtattaagtagagcaggctgtttaaatcacattttaagtaaaaaccaaagtgcacagatgatctgcagaacttctgggggataagaagctgctttcctcgaagaagttcacctccaaaccagcgcccatggctcagcagccagcatggcagccccaggggtacatgggacttgggcatgtgaggctggtgagggacagggacagctgggtccagcagtgcctttcctagggacggttgccacgtcacctgtctgccctgtacttccatttcctttctttgaactcggggggcttgcatcggactacctgtgccgtttcctcaaactctaaaattgagtaagttactgagggtttccgtggtctgctctgagaagatttcttgcttcctgatctgcctgtgtgttcgtgttgcttggtctctctctctgtctctctctctctcctctttgatcctagtacatacaggcaaggtatgcagcatttaaaatgttcataactcatcaaatggcacactgatcatcatgtataatttgggaatcagggtttaagaaatttagagatcatttatatggaagaaggaaccccaagtagaaacccaaaatctagaccattctgggttctaatctgtacctgccactggctaacatatggctttaagctggatgttacaatgagagctggagtttcgtctgattgcacatagccttgcttttctgtctttggaaaagtagctcactgcagagccctggtaaacgtttgaactgcattgcgggagtaggcagaagaacagaacagtccttggagcttggtaggaggtgtgagggcttatgggggacagttgtcttttcaagtcaaggaggaataagggcttctggggccggtggaaagggtgagtcttaggcagggaagggtgaccatccaggttagatcacttcttctgcggggtcagcttggccgctgttaggttttcaggatgtcatggggctggccaggcctcacccctgatatccctgagcatctgttccttacaatattgtggagtccgtgggggcagaagctaccatcctgtgcctgccctcactctcagtgtgactggtcttcaggatgtttaggtggctccacatgcggatgtacagctttcccctgcttgttttccccatggcatattaacagcgagatctgcaagaatacatcattttgtacagaacaggatgtatttcttttaaactacgttcctgtgtggacaagtggtatcatatgcaaaggtttaaggaccgttgatgccttgagatagtgccatctgtttgcctcaggtatgtggtgctaggacaaagctgccagacctcaccttccttcagtgagacaggaataggacagtatttgaaaagcatctaacatgtttccaagcacataggtttttggtaaatggtggcagctgctgctattttttttttaaattaaactatctaagagttgcattctgagaccatctaaaattctgagtcttaagctgtgttgactatatatgttcactaccataactaaatggtccttctgtattgcttttctaaattgtagaatttcaattattgtaaatagcgggccatactgtaggtgtggttcttgctaatttgattcgtactgttcaaattcttgtgtctgtccagataaactgtatctttacagaacattcagcgaggtacatatgtctatatcggggtgccagtggagtcaccctagtcatatgtaaactctatttatttggttccgaaactgaatttattttgtttgcaagtttggtatttgggagcatttaagaaatatccatagattcttgtatgatactgacattaaatcattaaataccatattttttaaatgcctctgtctgtttgcatggataacattaaagtggttagagtgggcacagttattggtaaagattacaaagatgtgcatttttatgacaactttaggtctcacataggtagccaaccatctgctccaggatgaagcatgtgcctgtttatcctcttctttggtaacgctaggtatatgtgtgcacacgtgcacgtgtgcgtgtgtgtttgtgtatgtgcgtaccactttattctcccacccagcctcttctcctgttttgtttagtttcattttcctcctctcacccccattgcaggaaacaaacactggctctctgtcctcccttaggtcttccttccgttcaaggggatcaggtgggtgggaaaatgttgtgcaggaatgccaggcctctgcccgaagccgggcttctgtttcatctcattattgaacagaagtcgctttttgtttctttgccttggtcacaaacaagcgcccagtcctctcttctttcttcctgccatttttcccagaatccatgtgggatgggaacagaggcagcgtatttagggactgtcggttgcttgatacccatggccttgtttagagaagctgcacccactgccccaacgtgtagctgcatctgatttgtttttgcaagtcctaatgaagggacctggatgaagttagtgaggttgccgttcctggggttaatgcagagtggcccatggagcttagccacccttcatgcagaaggtggggctgagggcagccagtgtgactgaggctcgctggcccaccctgagctgcttgtgcccatggggcccctggggaggagggcccagctgcagtgcgcatacatctgcccttggcagcagatctgtgaacccaggctgccattctggatttccggatagatgcaaagtgcttggacgtgttttagcagctgctgagaccaggagttgggcttagtagtaaaaagggggaacaaaataaaagaagatcaggagacaaagagcctacagtacaaaaaaggaaagacgaaggttgatattattagaaatacttcctgggcagccttactgtttgaattaggatcacccccacccccacctcccagaggtattagttgtaatgcagagacaaatggaaactagtcagatccttgggtcctagaaaagaccagctttgttcctggggtggtaacctagtacaacgtttccgttcctatttcttgacctctgaatggccccttctgctttgctaagtagatgatattattaggtgcttagactattcttcagataggatgtaaggatatatttttgttctcttcctcagtgaacttgaaatgattggattattttgtaatacgtcgatactacttttagaagcttttgaataactgtgtcaaagaagctttagaagaggttttaagcaggattgcagagaatgtactgagtgtgtttttccactcacaaggaaagacagcagctgaatgcagaagtgtgtgtctggttctaactctttatcacttcagggactgtccaggcagcaccatccgttgggtctcctgcccttcctcctcccacccctgccttacccctggccattcttttgtgaccagtagtcctttatgaatggaattctgagaatgtataattttctcagaagaatgcttctttagctcaccaaatatttcttgtttgctgaggggggaaaaagatcctccttggaaaagtcactgggtgccaaaggtgggtgatgaggagagatgaacttctgggtgtgcctagcaaagctgtttctgttgataggcgattaacaaaacagccaaacttgacctaacagactgccattttgagaggaatttgttttgcaggattaattggcttcgaggtgtactggtggctgtgcagtgatgacggctgtcgtgcctcctgtgtcttctgctcattgtgatgcagggcaagtgcttaggcctcagacacaggctccctgaacttcgtgttcagtgctttagggtggggggacttgagacccttgacttgactcggtcccactggaaagcttctgttgcttatttgggtaaccccaactctatcttattgggcagtagtgttatcctaattcttggaaatactcagtgtagaataaagagctgatgaaaatgtgtaagaagggagtaagtggtcattagagagaaatggtaattgggatgatgctctgaccccttcagcaaaaaataaaaggtgaatggtttattatgagctagttcagattctgtttttggaaatgagcttggttatacatagtgcatttgaaaagcgtgaagcatggactttcagatgccagctcctcagcctcctgtaactccagtcgcaaaatccctccagtgtatctaaataaatgcaaactcatcagtgccttaccattataaagctgggctggagaggcaggtggcctggagaatcaaatgacaagaagtatagggagcagcccagcttcatgatcgggggaatttgcatgaaaattgtgtacacttaagcaccattgtctattgcagaaagcacgatctggcctcttctactgactttccttccagctctgagattcagttttgaagacaaggttgttggggacctcggatagatctgttggccgtggctttcagtaaacactactagagactgaggacatgttctagacttggaatggtatgaagcagtcgaactttttaggatgggccctacccttagggactgcctacgaaactagatctagaagaggaggctgtggacattaggaggtggctgcaattgggaagttccagagagcttactgagggataacggatgtaggacaggaggctggcaaagcacctcagtgatagggcagaaggaaataaagtggttagggaaggagttgagagcaggaaattcaggtaggattgatgttaagtcttagatctttgaagtgactttctctggtctggcttttgctgttaccaaagtgaattattcataagtgcatatgagaaatgctgatgtaactcgattatgtggaatgaatttaaattcatttaagtcattcttttccactaaagtaagctttccctcatccagaatctgagcagcccgatagccaagcaggagtttccttgtgccatggccagtgattgatgtcttcttctatgatgctgctgaaatgctggggactctgaagcgcagctggagtgatcaaagcaaaattaaaatactttctcagtggtttgggagttgggtgcgttctgctgtattttttggttttcggcatctgggtttggtgtgcatgcatggtgagctctagctggagcagacgttacctactgaggctacgctcttcgtggtttctccttaaccatcacccacttgatcttccatgaagccccccaaatcttccttactgaggactcttgcttccaggttgcttttgtgctcatccattgctgggttatttggtcagtgatgatggtttctctgtactttttatcagtaggttcagaggaccttgtttactcctcattcatctctctccccaaacagttgagaaaccacttgtgggttaggactcatgctttgtttataatgtttgattctccaacctcacagctaatgggaagcccgtggaggagatactctgtaaaaatccatctcccatgtgggcttgaccccacttagtgtctgagtggtttggtcctcatagttctcttgggggaggaggaagggaaggaggaggaggtggcgatggcagtggcagcagtggtggcatcttggaccagagtgagaaatcttggaccagagacaaaagaggtcttctctcagggtagtgcaccatgagagggagcacctgtttacattttgtatcctggacaccaatcttgccttgctctggtgctggccctgagaggtgcaggaattttataaagagatttacaaaacatttttggatgaccaaattggtccctggttctagctggaatgaataaacaaactaaataacagtagagtgtgagagtaagtgtgtgtgctagagaatgtgtgcacatgtatggcctaggtgagttcttcactttgctgacttgtgaattatttggggtcctatggtcctccccatcattcttattcatgtcagtccaccatcattaaggaagtggaagcgaacacattgtgtacatatcactcccatagagagggagactggggaagaggtttgagttataagtcgcacctaggttaggtctggatgtgtctttgcaggtttccttgctagttccttggccagagtttccatcgtgtccctcagctgcacaattaaggtgcccccgttttgtgcaagtctcatgctaggcagtatgagatgacacaaactaggattctgttgtgagataagataaaaacacttgacatttaaaagagagagacaacttatgcggtgtgacgagacactctacgacttttgccagaagagaaatagaggcaacaagtgctaggagctcagaggagggtaagttccacatttggaactttggattaaaagaatatttgggtctggttgaaatcgaggcctttcatgagaaatgtccacacttgctcagtactgtttgccgaacactgtatacaaggccctcgactcgtgaatgagttgtaatgcaaaactttgccaggcatttggaatgtggagtatactattttgtaaagatgaggtctgaatggtggtttaggtcccaggccagtgtccctctgccccccacctccatatgtgccctcaagccggtttggcttagacattatttatctctgactactgtgtacagcttagttccatggggaggaaaaggcttgatgaaccctaccctggaaggctggtggctctgttttctgatggatgaggtaggagtggtggaaagctggtagtttctactttgtgcctgtttaaaaagccccctctgaggccttagcacttaacagatgttcaggattgggggaataaaggagctgcctttgcagaggtctgtgggcatgcagtgggtgagagagcaggcactgagtgccccgagtttcctgcctgtgtgggcaggaggattctcagtggaatcaggagcatctccgcctggtgctggaggaggtgtggagttgaaggtgggattcttcctcttgaaggacttgaatgagtttctgtgtggctgaacagaaactggttcaacacccatgtcatgatttttgtgaagcgaggacttggggtcccaagtctaggttttaggttccctgctgtaacccgtggccaccgagagagagttttatgataaaatgtcagcaaagtacctgacaacgtctcacgctagaatgagtttcgtacatgtttagttccctctctttttattccacgctcccccaccccaactttaaatcagaaacgtgagggtgctgattgaagctttttataacttttcttattgagaattgttctctggagttgtctccaagaacaaaggaattccagacgttctccttctctccttgtctcttctgtcctccagtcaaagaaaaactctgcatatgatctttggcctggagaaatattaaatctatgttaagtatgcagacatgaatgggcaaatgaaggatttgtggcaaagaagatctgccgaaacaaataagtcatgtaaatgggcagagggaaatattaaattgattgcatctttcagctcctggtacttaatgcaaagataaagtagtgggaaaaggttgtcatttgaaataatggaaagatgagggagttttgaagctagctgggatttttctgcctgttaatagagtgacttggattacagactataaagataaagagtagggccgttgcatttagtatggatcatgatgctgattgctgtctgagcaacctctgtactaagggaggagaagctaacatccccgggcctggaagatactggatactagctcattaaactcttgtgagaagccttcattagcattatgggaagacttgctgtatctatattatgaaggcatttagattttttttaaaatgcatgttcttaacattttttgtttattaagtggggcagtagattaggactgaatggatttgattctctcatcctacatagtgtgcccagaagccagaaggtttcccagaatttgtattatggcagcgagggcaaatttaattagcagataggaaaagctttggagcagtttaggccaatccatttaattgtatcagcaattaatattttgagaaaatggaaataattaaatttacatttcttctaggactttattttgttatcctttaaggttattgtaaatgaggagacttttgaactcacagactaaagcaaactacaccagataatcattaactttttctattgtgtgccacccttcccaaccagattgttccatagtatcacttatgaaccaagaacctgtgagcttgcaaaacgcatttttaaggagtctcaacttttctgatttgtgttaaagtttaggtgtgggtcccagaaatgagtttcatggaggggagagcttgtctctctgggtgggtaatacaggggccactgggggctcactgtggctttctggcacagacagttatgaagcaggggttactaaagtgggagagagcagccagttctccagcagccccagtgagagctctcatggatctgcctattgcactggggtaggagccatcaccgtcagcttttctctggcccacagtgccattttctgattaagctgagacctctgtaatagacacgttgtcattttttcttgtgtctaaaagtttgcttgactgcagtgggtctccagctcagagcaggtctggctagagaaaacaggaggtgatgactggagcactttgcccttatggaacgtgctctgatgtagaaagcaagaggattttccttgcagtcactgaaggtaccttgtgtacacagaaagaagacagagggagccccggatgcctcggtatccctcagagccggatccttcagacctgtgcagtacctgtggatttggttagtcgatgatgcgctgccattaaaacaaaggcatcggccctggaatagagaagttcagtgagaacctctgtactccatgggcattttctaggaaataatttcacctgccctgtgtaattctctggaagaatcacagtgagttggaaggaaacttaagacttggaaaaggattgagaggttagcccagaccacaccagggctctgaaggcccagctggggttagaacctgggacaccctccagcccactgtctcctgttccctggccatttactgccccactcccctttctactctcaggggccctggatctaatgaggggattcgtgcagtttgctgcactaatacattgcaagtggtgccaacctaaaggtattctgatggtggaatcagagcagtagcatcttattaggtcagaatctgtatctcctcttccaagatttttacatgatttagtgttttctgaattggaaaaaaacaaaaacaaaaacacacaaaaaaaccatgtctaaatcctagcatttcatcccatgttgatgaaagggcatcttttttttcccctaatctgtggttagaactctcagaaacttttagaagatccctcctatgttttggaggtttgcagatttgaaccccagttcctcccacagtgcttctccaactcctggaatgaggtaaacctccaggcagcctgttgacccaacccatgcatgccggtctttgggactcctagatgtggaccctggagtgaatagggatcaggtgggaaatgagttcctttgatgaagatccttgtaccagtgaactgaccccactccccgtctggattcctgtggtgattaccctctgtattagtctgttttcatgctgctgataaagacgtacccaagactgtgaagaaaaagaggttttaattggacttacaattccacatggctggggaggcctcagaatcatggcaggaggcaaaaggtacttcttacatggtggcagcaagagaaaatgtggaagaagcaaaagtggaaaccctgataaacccatcagatctcgtcagacttattcactatcatgagaatagcacaggaaagaccagccctcatgattcaattacctcacctgggtccttcccataacacatgaaaattctgggagacacaattcaagttgagatttgggcggggacacagccaaatcatatcaccctcttagcaaggactgtgttcgtgatcatgactggcattcactgaacaatgactaggtgccaggcacctcgccagtattctttaatctttgcacagtctgtagggtggatatggatattactgttccattttttgtggaagaggaaatggaggcaagagacctgattataacttgtgcaaggtgccatgcagctaagcagccagcccaaatccagacctgctttcctatgattttcctgcccattactctcccatcgtagctcacctaatacttcctagtgggctgctgctgaacacacacccagggatgacttagtggcttgtcttgctctgaagaaggctaggcaccatgttggatgagttcttgaagatgtcttgctctagtcaagaaacttttaaatctttggagtttttgtccacatctgcctagttcttagtaaacatgatgtgggttctattagcatggcgccctccctcccttcctaccacctttatatgagcggagaacatctatgactcttatgagaaaggaaagatgaaaatcagagtgacatagtatagttaaattgcagatgcttaattataaaacagcttgtttctgaattttaattccttgcttttctctgactttttaaattcccctccttaggcagaattcatttttacattgatgattttttttttttttttttttttttgagatagagtcttgctcttgtcaccccggctggagtgcaatggtgtgatcttggctcactgcaacttccgcctcccgggttcaggcaattctcctgcctcagcctcctgagtagctgggattacaggcatctgtcaccatgcccggctaattttttgtatttttagtagagatggggtttcaccatgttggccaggcaggtctcgaactcctgacctcaggtgatccacccaccttggcctcccaaagtgctgggattctaggtgtgagccgccacacctggcctgatgaattattttcatgtgtggaacaaaactttgatgctgatcagtgattaggtacctttgtttggttcatttttaactaaggagatttctttctttttaaaaccattctttaatcttgtaaaaatatcatttaatgggtggatgttttagctgtgatgaatgacaggttgtcgtaaaggaagaaaggtatgtggtttccagtaaacttttaattcttttgcaaaataaaaataacagtcgtacagagagtaaaatatatgaagagtcaggaagtgatttatcaaaatcagatcttggactgctggttttaccatgaattaggctcttggaaagtgattgggccagtgtaggtttacattttttttttcttgttttatttgtcaaagcaaacttgtggttgcctgcccgtagtttaattctgcctcctttgggcaaacaaccgacttttactgggagtctttctcagggagataaaggtgcaccctgaaactctgctctctgattcctcagcaaagtcagtcctgagtatggggcttgggtgtctctgcaaggccttgcaagtgagatgggctgtcacctgagctcaggtggggctgctcctgccttggacagcctccccagcttctcctgcattatacccaggggctggagggcagagagcaggtcttcttctgctggtcggggcagtcacaggctttcctctcggcctgcttgtcctccgggtgggtccagcacccgctgggattcctgtgggcttagtcactgtgtggcggcggcagaaggactggggaaaccgccggccggccctggtgcgctgtcaccccgaaggaatgcgggccaggccggggctgctgggcctggaaagttctccagtccctgttgcggatctggcctgccgactcaaagtaaatctctcttcccctttatttcccatcaaataaaaaaggaacacgaggtagccactgtactcactgaagatgcattgttttttttttttttttttttttttaagcgagcagcagcaagatttattgtgaagagtgaaagaacaaagcttccacagcatggaaagggacccaagcgggttgccctgaagatgcattttttaacttgctttttaactaagtatttttgctctgagctttcctggatctgtaaacacacccccagctattcaagatgggcttcttggtgaaaagtgatgtgtcctaggagaaatcacgcctgttgttgccgctggccatcacagatcccggtgcctgtctgtgaaaggctggccgggctgggtggggatgagaatggtcgggttgtctagactcagcctggactgtctttgactggaggggcctgagctcctcctccactgctcaagaccccggttaaggggacagcagagcagggatgagaagtggccctcttcacatcacctcccagcaagagggcctgacttagtgctcccaccattgccagccccagtttcagggtcccactcagttgtatttgaataggtctcatgacatgtgctttgcttgaagagcggctattagcagcagacgttcaagaggctgagctcaagcaggtgagcatgttctgagccattgtgaacccagtgaggtgcctatgctgatgcccagggccgcctgggcggggtcaggcccccatcgcttcttcatcctagctctgggagtgcattctgcactctcccgaggccagctggtggcctttggtgatcaccctctctgtaagtttttaagtggcttcctttcctctggtggagaagccagcacctttatcctatgacaagaaagctctttgtagtaggtggtagtagaatcagacagatctggcttaaaatcttggctgtgctacctcttggctctgcacattggtgaagagaatttaccttcctaaggcctctcagctacacgactgtggacactcagcttccttctaaggtcgttgtgagaggtaaagaaaaggggttagtccagggccagacatggcacaatgcctcaatgaaatattagctgatactatcgtaatttttaaattcccataggactcactgttaaaggattacaaggctgacacaaaaaatactgcattttgaatttgtgtctgatttatacatttccaaagagtggaattctcactacaacagctgttctttgaaaggttagatctttgttctgagataaattaagtggaaaaaggtgtagagcattatatgtactctgattcttcagggcttaatttaaaaagagcatgtttgctggtgaatgctggttcaatcattaagaagtttttgagaaggaatcccagaaagtaataagcacttatttttcatggaaaggaaccggaagtgcttggtgacctccacaggtaatcttgtattatttttgcactgtttggaattttttaaccatgtgcttttatttcttctattcttttcaaaggtcagtaggtgttatctggacaatagggttctggtctgttttctgttttcttcattgtactgtgcattaagaaaaaccctaatgtgcttttttttttttttaagtgaacctttccacatctcattgtccttcagtgagagcaggctgtgtgtgtggtcttggtgaactgtcccgttccctggagacagtatctgggggcctccctgcccttcccagtaagagctgggccttcacaggaatagaggcctaggattcgccttcatcctcttgaagagccctaacagtaggtcctggctggggtctggcatagaatgcccttggcacgatgtgtgtgagtgtgtctttccttagtaaatggccttgaaaatgccatgtgcttctggcaggcctggataaggtttgccctgcataacccttggaaagcacagttctcacttgtaacaccctgtctgcaggtccatgatattgtaattaaaaagttatgggatcacaagggcctatttaaagggcatctggtctaaaggcacagttaaaagcagaatttgtgtcagtggctcccttaatttctcaaatatggttctgtttctaaattcatcccactggatgtctgtgttgagttttctgttgatgaaagaatgtttaaaaatgaggcagatccaaattctaatgtctgagtgtaccactgcttaattactttgggcaggtcacctcacctctcttggaaagaaaggtgatatactacatctgtgattttcaatttttttttttttaactagacccacagtaaaacatagatatacaccatgatcccaggacagaataagtatataactaaaataagtgttttgaaatcacttcttgtctgacacagcactcacgctttctattcatgtagtaccacgatactttcttctattctaatgctggtaagagatgccttaaactgattttgagaactaccaatgggtagcagctagcggcttaaaaaggatgttattaaggtccttttcaccctgattttgactctgttggctctcagctgagtgccccatacttagtgcacatagagttggcctctgaggtcagcctcctgttttcctgtgaaaatgaggatggaagagagtcacttgtttccctccttcatggctaccccctgaggactgggaagaatttaagaatttgagtatatgttcccaatagcatgatgtgtttcattgttcatctgtaagcatttttaaatattcgagatctgtatcttgggtaatttttatcaactttttatttgtaaaataatttcaagtcagttattaaagtaacaaaaataatggcaaacttgataccttcccgtatttttttttcatatttttccttgaatgcttacaaaaatattaaagaatattatcacatcattgtagtcaccgatgaattattttctggtggcttatgattagaagagcttgactcggagtggaaacagataacatttgagtgctctttctgttaattcatccttgtcaataaccccattagctaacttccagcaaggctgtgttaggaatgtggaatcaattagatgaattttgaaaataacttggtctgttctaaaaggccctatgagattcaaactgttgtggcctggtgcctggtaactttgatggccattttgaaatgttaccgtagtgataattcttctggaatctcaagtcattaaaagtgatatggctaactctgggccctgtgctataaaaatagatgtcatgggatgtgtgaatcctttcttcagtgttatagttaatagcaactgaaggaacgttttggtcaaatcccgaatacttattaggggctcactgcttggctgcatttttctcctctgcgtaaatcatctatccatgtaattattaacccctaagaatgaatagcatttttaaaagggttccattttcccctcatatgactttggttcattctcctccttgtttctgtctctcagtgaactttccaaaagatgggttatgatgaaagatgaatcgtcgttgataactgctcttacttatctgtgtatcgaaactgcaggtagtgctcttcagctctgtggctggatttagtgcctcttctagggaggggtgggtgttggcacaaagcgtatcccatttccctgaatgtcgtgtggacacgtgagaggacagtgcaccctttgggcttggtgctgcccccttcacgctactgaaccccagggtcataattaaaagctgtgttagctcttctctggttagaggcatacaggttggaggcttgtacatagacgtgagccggttggtctaggccaggaagcaaaccattggaaaatgtggttagcagtgacagttgacagcatgtttgcctgcagtagtggtggttggtgctgcgtgttgactggagttgcttgcattgggagagcctgacttggccaagtgtgtagcttgagaccagttggattcctctcacagagacagtcttcacccccaagctctgggtgttgggcgtgcagcattcgtattcagcaaacatttgctgatttccgcctctgcaactactgagctcagctttggggatctgaagatgaatagacacagccacacttctggggaaatctccctgtggggaggctgacatggaaaccaaccaaatgggagtgtggtgcatatcttattagagctttgtgcaaagtgccacaggaagcaggagaaggggtagattggtgtggagggggcaggggaagacttgcctaggagcagggcctcgcaggatgcagaggagtttgccaagtaccagagattgtggggtaggtgaataaaggctgagtataaggataagtcaattcaggcagatgtcctctaagaatgaaggtgagaatgctggcggaaaccagttgtggccctgtctgccttccctaggagactggacctgactttacaggcagtgacggtgaagcagggcagtgccacgagcagatctgtgtttcctgaagggtctctggcagctgtctggggaaggagggaagctggcagagccgtgggtggaggcagatgccattgctatggagtgagcatggggaagggggtcggaggccttttggagatagatacagcaagacttggtgaaggatgaagttggggcaggtagaggaaaagcaatgagcttacggatgactggagactgactggagaagatgaccacccttgccattaactaggataggaaacaacaaagggtaggagtttgacaggggagaatgtttgtgctgttgagttgttgagtttaggtgcttgtggcacgagcaaggggagtgagctggtctaggaggtttttggaaacactgacctggctgcagagagggagatcctgggacacctgttttgggagttatcccagtggggaaggatcactgggaagggggccacccctttgggaggggtcagtgggacgactcccaagggaagaggttggttatagggagttaaaagaaaggagcacccctcacgcgagcccatttttcaaggatacatgtttgtcttttagattctataaggagtagctgctacacagaaagatgtctacgtgtgggtgaacacctggcgtatcccatgcagggaggcttcagcagaccttggtggcgatggaaccaccacagtgatccgaggattgggtctgaaggctcctccgagtctccaataaaaggggttgttttgaagggctcaggttcttcctgggcttttttgggacagtcttgctctgttgcccaggctggagtgcagtagaggcaatcatggcttattgcagcctcagcctcctgcctctgggctcaagtgatccttctgcctcagcctcctgcgtggttgggactataggtgcatacccccatgcctggctaatttttaatagagatggggtcttgggctcaagttatcctcccacctcagtctcccaaagcgctaggattacagacatgagccactgtacctggctgagaaggtttttttttttttcccccttccaaacccccatgtggtccagacgaggccagaggatctcaggggaattccctctccgaggagcctccactgctattgcatggcccccagcatagtcatttgagtgaagagccctccaaaatcattaagctgatttgtagaatcagtttgctgtctgactacctgatgaagatgagaagtggtagacctccccccactgtaaggtcttaacaagatctaggtggaacatgggactgtttgcaagctacttctgtttctgaaatcacatgcttgggatcccaaataatctactgaaagctgtcttcgggaggcaaagcccagggatttgttttgtttgcccctaatcatctcttccatcccctttctcaaaagtcttatatctagataatttagtacatttgatctactaacagccagggccataacaggagctgatattacataccccggaagtcctttgcaaacacactgtagtggcgattgattagtgttccgagccataggtaacattagcctgcctcgtaggaccctcagatgctgaccgtatctgctgcaattcttagatgtaaaagagcgcgcatcgtataaatcaaaactagatgattattttcatttgaaattgttgttgcactgtaatttctcagggttttgtattttccaacagtggtgtcacttaatgggaagatcgctcaggctttgtaactgggcataataccaggtattctcgtttaggcattctgctcagtagtattaacctgaagccataggacatgccaatgtttttttccgtgttttttaaaaaaattaaaatggttggctacaaatgcatccttttttacttcagagtaagtcggccttggttaagtcttaatatttctcatgcctatttttttttcttcaaatgaaaacatacggagagaaaatagcatgtttatgccttttggttgtacccagcactgcccagaatggcttacagagtttatacccatggaggtttcgtaaaggtgacattaacttcgcagtaaagtcactgaccccgaacctgtgtcacttcaggcttagccaaatgctaacagagcagctcaaagcttaagcagaggtatgtgcttgctaagtaagtgtgtgttttggactaattggtgactaccattctgaacattaactgccctttgtgttttaatgttgccaggaggccgattgtgtaacctttggaggcttccctgagtttggagaactgaattcatgtggtgacttcctatttataatgtctttgggggagctatgaaataacttttcttctaagtgtgatttttgcttttttaaaagtttttatgttgttgtcaattgggtatttcccttctatgccaagacgaattgtaggttcaggtttctatgcagcctgtatgtaaacactggccctaaagaaggactctatcactctactttcagtttcttgcattaaaacaagtatgggtagcggtatccttcttatttctgcttcctggtcctgtgtgagaccctgaaaggtcctaatggcagtgctgattagattgtggccagggttcacccacaagttccgaagctggggaaggtggaagtgctgttaactgacttgtcccatgtctggggttttgcagcctggggagaggtgaccacccctcgtttcagtccaggtagggttttatgtccctgtcaaaaatgtgttgtgtgaagtaccttgactttcatttcccagggaagaaagcccgtttcaattggctcaagcggaaaagagcactgtgggtccacttaatggaagagtctaagagtggcttcaggaagtccactgggggctccccgtgactctgcccacctgcatattgtcttcattctaaggatccatgtggtagcaaaagggttgttacaactttaaccctgcatccccaccttcaggttcagtacccaagggtgagcaatctgttccagtggcacagacctgtttcaagaggtctctagccgtgatagtgctaggccactgccctccaccagtgtgttccagagaaagatgctctgatgtgccagcccaggccatgaggttcccggcctcagtaaggaagaaggaggacaaggtggtcccttaggagaaaatgtggatattcaagaaagagggtcgcaaaatagcaaacacccactatggctgggcagtacagggttgcagaaatatattttgatgtgtgatcgcattggagctacttcaaagagcaaacacaccactttgatttatttctcttagtgatacagtatttagagagggagatactttttatcttcatgggatacttacagtggtgctctagaagccatgtactgcttctggcttctccttcctttcctccaaggctcctcctgcctcctcccaaagctctgtgccctgaaagagccttgagccattgctcagatgtcaaaattgtattaagcagacacatcaaattaaaacttttgggatcactcaccaatatggtttcctgtacagtactgccctgaggggggattacaagtagttatgcatccatttcattgatgtatcatttttattaaaaagaaaaacaatccaaccaagagaggaagtgtagccagctgcctaaagagtggcgatgatgggagatgatattttgattacattaatccatatcctgttagttcactttgcttctgtcgctgctgctggtgaagttactaatgtgaactaattacatttgctctgaaaagccagaatttttaatgcatctcagcaagaaaggttaatattatcaatttaacagcatgaatgaaacattgtgtgtattgaacttgaactgtcctaaaagcttggataataaaaacccagtggcttcttttataactcactggataaacagttattggtgagacatggataaggctttcttctctttcagttttatggggggtggtaggcagtcagcattagatgctgtctgtttacagggtgatatcgtaacttcgtgaaattggaggccacatttaaaaaggcactccttccttttaaaagctttgcaagggggctgcatatattttcctaattagtgggaatattttcttttttctttttttttttttttttttgagacagagtttcactttattgtccaggctggagtggagtggcatgatctcggcttactgcaacctctgcctcccgggttcaagcaattctcatgcctcggcctcctgattagctgggattacaggcatctgccacctcacctggctgattttttgtattttagtagagacgacgtttcaccatgttgcccaggctggtcttgaactcttaagctcaggcaatccgcctatctcgggctcccaaagtgctaggattacaggcgtgagccaccgagcctggctggtgggagtattttcaaagagaacaacaattcaccacaccccaacatggtaacagtctttttgttttagaagcatctgtgaattgccaagactcgtagaactaagatgtattcaaagtcagtcgattttctggaaacgacccagtccctgaagatagtcttttggggagttgagtgttttgagagggacaccccctctacagggacttaaaatggaatggctttttgtgtgtgcacatggtacctgcagtgatttcttgtgtttaattacttcctgcactcatctgacttacacagtggtaaacaatgaggatgggaacaggcggcagctgctctgtgccatccaccgtcttgggaaccccagcgtggcattctctctggggcagcatgttgaagtgtttggctggtgacattttggtgaccagttggctcctcattgtctttcaatgtggagattaggaaccgagcgaggatttggaacccttgcgtttgttctgccaagaacatgacttgcctctggcctgagagcagtggagtaagctgataggagctagaaatactgttttgggtaggacttacccaaaagagtgggctgagtcacagaactcccaagtttgagccctgtcaaataaattctgaattgttctcaggtatgtttctcaattggaatttttttaaaaatttaatttaaaaaagacttcgaaaagttaccttgttctcatttttcttctccctctttgccccgtccccacaatatcttagggcgaagaaaagcaggtttgagaaaagctttttttcatcatgtatttgtaatagctggagcctgctgagatgatgaggtggagtggagggagaaagagaccttgaggaggtgtggagggggaaggggtggaaagttctgtcgtcttctgtgcctctctctctctcttgctcagggtctccagtcagccctctgggtttgtgcccttcgtgctgcactgacaggtcaaagccgactcaggcctttgatgtctgctctaggagcaaaagtgattcctggtcccgcagccgtttccactgccttgtgtatgaaggtctgctgctctgaggtggatggtggctctaggcaggctgtttccgctgggtgcggttgttgctgcaggtttttctatatagcttggtcatgctcctgtatctagattaaaatcctatgacagatgggcctgcttatatctaaacttattcagagagtcttatgataggcaacaggttaccctttaccggggtaaaacatggtttattctacagtttggtcccgttgtaaggccaggagatagagtctcactagtttgccccggctgaactcaaactgctggactcaagggatccttccgactcagcctcccaattagctgggactgttggtgtcaggcacacaccaccttgcctagcttgaagatctttcttctaaatgagcgggctttaaagtgatcagtgggacctgggcaggttggctcttgcctataatccaagtgctttgagagaccgagacaggaacatcacttgagcccaggagttcgaggctaaagtgagctgtgagcacaccagtgcaccccagcctgggcaacagagtgagactctgccccaaagcaagataaaattatcccacaggattttagtcctgacttgtgtattactatgcagttgtgtctgtgtgaggctcagattcccccccatttaggatttgtgtggctaaatctcagatctcattttcaggtgaatttctctattaaggttataaaagaccaaaataactggaaattcaactctgtacttgaatacttggtaatgcccagcattctcttgactatcccatttcacagtttgccggtcatttccccagtgtactcactggattcttcccgcagccatgaaaggtaggtataattaactccagtttacattcaggacaatagaatgttcgtcaaaatgcttttgcacatgttttctcaccctgagtggctacacttgtacagtcataccctccaaactctaagatgtatactcttacataccaaaacacaaagaaacaacaggaagtaagaacaaaactcaagaggtctgagtgacatcttgccttgcttcacaacttcagagtttgcattgctttaaaaacattggttataagtgagtgtggaaacagtgtgttcactatttttatgctgtggctgtgctgtgcaggagctgggcttttcgtgcattttagacagaattgaccttggttaatgcttgacttgggaactatgcagaaacatccaggaagtggtggtggctgatcctgaccgtcctcagttttgtgaagcaacagcctctgtgcctctttctctgcatgctctgttgacggtctagtcttgagagagaacctgctgctgtcccgtctgtcgtagccttcctagcaactcttaggcctgcatgctgtgttttcatgatctcccccaaagcggcactttgatgttttttcagagtcaaagtatcactgtggatatttatcccaaacaaaattgcaaactgatcaaatgttatgtcttttgataccaaatcaaaaacgattcttggtggctgatcaggttgtctcctaaaaatttgccttttgaacctatactgcctttatgagatgattatgaaagtagaaaatagcctgtgaaaaatggtacctttgctaaaaagaaaaaaaaattttttttgaaactaagagtctctgttgtccaggctggagtgcagtggcactatcttggctcactgcaacctctgcctcccaggttcaagtctcccgagtagctggaactgcaggtgcacgccaccacatgtggctaattttcatatttttagtagagatggggtttcaccatgttgcccaggctgttctcgaattcctgagctcaagcagtctgcccaccttggcttccgaaggggctgggattacaggcctgagccaccgcgcctggcctgctgtaagaaaatattaaacttaggatgggaaatgtgatctgaacaggattcctgtgaaggtacccagtgtaggtcttagtctcctctccagtgtacatttatggaggggcaagatttcaccattctgtgaagaactctgcgtgttgacgactgctcacgcctagggaataaatttcagagcatgcgtagatagtgccattttctacttaaaatactataatccattatttacttcggaaaataaaagcattaaggctgaaagttttgggttagtaatcttgatgttttaaaatgccttagcattccttcatttgttttgcttgccacgtggttttgctctgatttacacacctctgtgcatggctaatccactgtgccactcttggggctttattaactcttctctgccagtttttcccttagagaatatcatggccattctctaagatgataaatgggactaagagtaaatgcaggctgaaaaagcatttaacaggtcaaggatctgaagcttttaagaaggcaaaacaataaataagaaacccaaacagagtcttgaagcacacccatcgaaacccaagtttcagaatttgctgcagccttgctgccaaatcacagtaaaagctgaaaaggcttttgtggttagttacgtgtgatacaagaaatcgatgtgtctgagagaagtaggatttctctttttgagggggaaaaatacagcaaggggaaatgttttattaacaataaatatgcggcttaccatatctgtagggcacagatttggttagtagtattttgaaggcaggataaaggaagatcctaaaatctctgtgctgtgtagcttccattcgagctgcacatgttaaaaacattctaggatccacacagtttaaacaaggtggctggcttaggaaatgcttctccccattccttggcatccccacaaccctattctcctactttctcttatgtatctggactggcttttaaaagatatttagtgaaatttaattttctagggaaactccactttgtcaaaagtgtagtattcctcaaggatagctttgctggtcggcaaatctcagttgagtgtatttgtggtttaaaaaaaattctttctgaatagaaatacaaagagtgataatgtttaacattttattttttaaaaagctttacgctgtgtaaattgtgggttgacttcatgtttctaaactttgtcttttagaatgactctcttgggtaaattattagcagacactctcgtgttgacatgtccattttcctttccattaagctgtctccattgcagttctgttgatatggctttatatagttttcctgagcttttttttttttttttttttttttttgggaacaagatacctatgcaagctgaaaaactcttggctttttagtttgtatcacttccagaaacttttaaatgctacgtatagaagtggctttcttttagggttaggtaagatacttccttttttggaaatagttttgccatttggtctcgctgcctgatttgtgctttttcttcttcagcaggtagtgggaggctgtgtattgtattgccttttaccagacacccagaggggtcatgttggaaaatagcatcctcttagcaaaaacacaatcccttctctgagaataaattgccaagtctttccaggtcattgatggactctcaggtgctgcatttctgcacgtcggggaacaagggtgaagaacagagctagtccagcactgctccgtcctcccgcatttcttcttctgtagagtcttttgcaaactagagagtcttgcagagagttgttgggttttcccaggagatactgtatgcaaagaattgtcatgaagacataaaatcaagtcttggtgtaaaacttttaataaatttaaaggcatgtctctgtttttctcctcctctatggggattttcatgtggttagtaataaaactgtaggcagttgtatgtctagatttctatgtaatttgtttgtgttcgtatatgcacacctgtatacatgtgcacatgtattcaagaaagacctgcagtatgcttgaaaggattgaggtgcctagtttgtggtagtagctgaacagagtgggaggtcaaagttaagtcattgtgaggcaagggaacttgacttagccctttaagaattggtctgtccctgctaagccaaggctattagtgttttcttccctagctgtgttctgaaatggttcacctgacattcagctgggttgggggagaacctctttaaacatcagatcttattccggaggagtgtatccagccttctcacagcatatcctgttaaatatctgttcaaggttagcctaggcctggagtatggacagcatgaagccagatctaaaacagatcagttcatggataaatgatgaatttaataaaatttgaaaataaaccccacataactagtgctgctattgatcattcatatagccagcaggagtggtgagaggcttggtctgcctgaggtgtggagatgcttgtggcggggggcaaggtggacgagggctggggctgctcctggagcatctttacgcgggtggaggagctctgacacagtggcagtgtttgtaacactttccaaagggattaaaataattctgtagagttaaccctaggctagtgtggcttgatctgaaacagtcccagccagaaggtaagaactcctgtgttatgttgttagcatacaatttgctgaagttcacattttaaattttatatttaaaaaccaaaaagtagtactgatcattttggactgtttcaaagtgatattgtttttacttgttacaaacattggcttgcctgcatctaattgcactcacaatgggccggatgtggtggcttacacctgtaatcctagcactttgggaggctgaggcgggtggatcacctgaggtcagaagtttgacaccaacatggtgaaaccccgtctctactaaaaatacaagaattagccaggcttggtggtgggtgcctgtaatcccagcttctcgggaggctgagacaggagaatcacttgaacctgggaggaggaggttgcagtgagccaagattgtgtcattgcactccagcgagtgcagtgtaaatcccttaaggaaacagtgtgttgtggtaatcgtgatatcatagtaaataggttttgttcgttatttttttcttttacttccttttctaccagtgactagtcctaatgtgttctaacttttgaaaataaagtacaaattagatggatttaaacatacgggaagtaagacggaaattcattacttttaaaaaacaatttgttgtggataagatttagaaatggaaacacaataaactgtgtttccatgacacaggtatactaccaagttcttacaatgtacctttgaggtaacgaattttcatgtcatttggagtagggctgggccagtgagtcactcatctccttgttcattcattacgtgaatacctagtaaatgcccactaggcaccctggagtcatttgtgtagagtggcatctctatacaactgttcgactaactgtcggagacaccctaatcaccccagccacaaacaaatagaacattgtatgtgtgctgaatcccacaaaggccagacatgatgccatgagaccaagaaggaaaagaaataatgtggaaagggtttggggtggaaaggtggggaacctggaggcgggccacatggggccccagaagccatgttgagggttttgtcttcaccaaaggatcagtgggagattagtgtagaacattaaacagaggtggggtatgtgtcatatttccattaaaaaattcatcctggccacagtgtaaagaatagattagggaggaagccaatcaggaagcaattggagtaggcaatgcaaaaggcaaagtgaacttggactagtggtggagataagttgactgcagagagagtaggaagtaaaattggccaggcctgtgttgggggtgggcttgtgagcaggatatcaaagataatgtccaggattctggcttggatgacaactatggcaatgcccattactgagctaggagatgctggaggaagatcaggtggggactgtgagcatgagtttgatttttgcagatactgggtttgagacacttctgagtcaagcaggcatttggaaatgtggactggtgccgagaaggaattcccagcagtgacttggtttaggtggtcctggaaagtagaaacacacacgagataattctggggatggagcttaaagggacgtcagcgttcaagggccaggtagaggatcatgagctgtaaagggacccaggtggttccagcacagcgaggaaagcatgcgagtgtgatggccaggcttccagggagagaggagggttttaaggagaacaacgtgctaaaagccactaagaagccaagcagagtgagaaatgaagacctccactgggtcttgcaagaggggaggcctttgaggacctcacctgagagctgatgaatgaagtgatggctggaagcagctctggagagggaggaatactgtggggaggggaggaactgaagaagtagagaagcatggctgtgcacaggggaggtgggatggcagccagggaggagcagaggtggaatgtggatcttgttttccccaacagagatagaggggggctaaaagtccatggaagggactctgctgagagggaagggtggatccatgagacagaaggggagagctccagtaaggacccagaggtctgaggacaggccaaagcacagatggagggattagctttggatggtaagaggaaggacagatggccccttaaacatgacggtaatgcaaactgctctgttttttttttttcttttggcgtttgtgatgaactttgtatatgctttccctgtttgannnnnnnnnnnnnnnnnnnnttatatattaaacgggtcgtctcagatagcgtgaaatcaggccaccccccacaacaaataagaagcccgggggcgggtaacaagccctcaggatcagcgggcacccccccacaaaataaaaccggtcggaaccccataagccaacaaagacggaaactccttcaccaaagagcaccccaaaaaacaccggcgcccaccgccaaaagcacaagcacgcagtgaaccaaatagaggaacggaaagaggaaaggccacgcatagccccaatgaaaaaaaggcgacgaagggccaaaaggcaatgtggcccgcgcaccctataggacgttggcatgaaaacatggaacaacgcacccccagtctcgatccctcacccccccattagaaaaaggaaacaaccattctcctcacctgagggaaaagggcccctaaccccggaagaggccaggaaacattcccagagtccctcaggaggaggactagtgctgggctcctttcctcctgttctgctgcctctgagaggagccaggattgaatcgtagccttgtcctctgacctggagtctgggagtaactctcttatgacttttttagcctagtagaattgaacatgaacttcatgttttaagggatggttgcatttgtttgaatggtcacttctttttctatcagtattagctaatatagggagaaggaagtcatgcttctcaagtaaagcaacagtatctgtgtatccatttacttgattgagctttctactgaattacaggagttaaattatactttgttacactcttggtattacaaaatgatggccatgcctttattataaaatgacaccagttattctttcctggaggatgtgccttgtgtcactagccgcactaagcacttccccactagtggccccatgtggttgtgtgtcatcgctgactacctgttacaggtgaggaagctgggtggtgcagagacagaaagccggtggcccagtcaggagctcctaagtggcagagccctgtctcctgggttccttctcctgtctttcttgcctctcacttgaaataagagaggacatcagaactggcctgaatggggccctggtagggcaggaacaggacacctctgtggttttgttatgatgtcctgaggataaaggagtgaaaaaaaaatctttgaggaattgaagatttctttatgaaagatggctgaaactcctgacagcttttcaaattcatctttggagaaacttccgttttctctttcctgttccgaggcttaaagctgccctgaaatctacacatttatcaacagtctcttgtcaagactccagggagacaagaactcttatacattgctgttgagagtgtaaaacggtacaacctttatggaaggcaaattggcgttataaatgcgtgttacctttgacccagaaattctacttctaggaatttatcttaccaatacacctgcccacatacaaattgcagcattgtttttgatagtaatacgttagaaataacccacgtgttcttcagtgggagactggttaatacactaagatatatgcacaaaatggaatgctctgctgctgagagaaaccacaagtatgccctgcacccctgtgaatagatctccagtatattaggtggagaaggcaaggcaggcttcttttttgtaaagttaaggagggtaaataagactgcatgtttgcatctgcttgtatttgtgcagactgacactagaagggaaaccaagtaactgaaaaacacgatgattcaccggggtaggtggggaaacatctaggtcgggacaggtatgggagtgacacacctcagtgtacatctttgtatcatttttaaaagtctgtgcttgcattatgtatcaaaacttagtgctatctcctcaggtgcagggttctctggaactctgtctaggttggtctcttggatggcattcttggagacttgccggaaaaccaaacaaaaggtgtgagtgcatgcctcctggatagatgtctttttagtgtaacttagcacaccttgtacactgtcagggcgcctctcagatgagtcatcccggcagcccctgctccatgagtgtcttccccacagtcctgagtgcttctaaaatcatctacaccagtggaggcaaaactagatattttcttagtttgcagaaaggaatatttccagacaacatgaacttgttctcctttggtctccttttccttgtcattgttcaagtcacaaggtctgctgattaaatttccccttgggtttcaaaagaacttgcttgtttggttgttgtgttttgccttttaatttgagagttgaggcccccaggtgcatgtggtaaagaattcaaagggctaaatgggtgtgtgttgttcgttatttctttgaacctcttggcacttgaatggtgtcagtaatttcactaattatggttggcaaagaaactctgacacatggctttggagctgtgttgttcttacatcatatctcttgagttgaacctatgctctcttgatggatgaactcgtaattcaccaggtgcgtggatcgctgtgattaattgtttcaagctatcagttatttaactctctagtgccaaatgttcaggagaaaatgtaagtgcagtgtaatgtaaaatcaagccggcaactccagcaatttgctcttcaaactatagctctatcagttcccattcatttatacacttacactactcaatttgtcgttgttgttgttgttgttgttgtttttgagacagagtttcactcttgtcacccaggctggagtgcaatggcatggtctcggctcactgcaacctccacctcccgggttcaagtgattctcctgcctcagcctcctgagtacctggaattacaggcacccaccgccacacccagctaattttctgtatttttagtagagacagggtttcactatgttggcctggctggtctcgaactcctgacctggtgatccgcccgcctcggcctcccaaagtgctgggattacagccactgtgccctggcactactcaatttgtaataaatcagggtaagttatttttggtgccaagtcgattaattgaatataggttattttgcatcttagattccctctgacgactaaatcttataagcagaggtatgtgagcatgagaactgtgtcgggtggtcctgaagagattagtggattagaaggagatttggagatttttaaaaaagcctctggacagtgagttaaatggtgggttgacactctgtggtcgggactttttggagagtctataaagttctgctgtatttctcaagagctagagagagatgatactatgaccaaatttggtttgaatgtattataatgtactgagtatcactaatttgttgggaaatgactgttaaaaatacttactgacgcttaaaaatatcacctatagcattagtataagtagccaactgatttacatatatttcatgtgtgtgttgggagaggggtgtggattcgttaggccaaagatttcggtaatatatttggaagagataaatgaagataaagagataaattaccttttgaataattccaaaactaaaaatgcttcccttaatttttatttctgattttcttatttctatcagagaaatgtttctcatgtgacaaatataatgctttcatatttacttctgcatgcacaacttttaattaagtattaattgattaattttttagagacaggatcttgctgtgtcatccactttggagtgcagtggtgtagtcatagctcactgggacctcaaacacctgggttcaagggatcctcctttttcagcctcctgagtagctggaactacaggcataagccaccttgcccagcaaatttattattattattatttttgtagagatggaggtcttgctgtgttgcccaggctggtctcaaactcctggcctcaagtgatcctccttccccagcctcccaaagtgctgggattacaggcgtgagccaccacatgcagtccgtgtacactttcacaccttttaatttctttactcattaggtgcattctttagcaattatgtgtaaagtggaaatgagcgtgcaaatcgtcattttctattgacttgcactccagaattggaaaattggaaaactgtaggaaactggaaaattagaaaactgtaggatctaaaacaaatcgcttctatgacttataatattcacttgtagaactcactggcctttgtcagctttcagagtatgtgaacactttttgccatgtaagtagttagtccattggcaatggatatatgtaagttggtatcttcactgcaaacatttagttaattgcgtttattcttgagccattcttgctctacccttaggacttgattttcagtagctacagtggttattccagaagttgttagaattaagagccaggaggaggtactatgtaagctacatttagactccactggacactcacatattgcacgtggaatatcttaaaggggttgtgtgctgtggtcagggtgggaattatctcttttctttccatgagacctccactgtgcattatttaagggcctgtcaattgcccgttattcaagttttgttgttcttggaggacactattgcctatttctttccttgtttaaaaaatttcatttaggtaggcttagcatagttgcagtagaatttaataaatccttttttttttttacagaataaatctttttattacgtaaataccctttaatttgcctatttttaaaattcttgtttctgtgcttaccttgttgttagacagccaaggggatatgctgctctttttagtgccaaggtaaaaggtaaagctgtatcttaaatatttgtatttctctttggtcttggtgacccaaagtgatttgggtcattctgacatttaatcaagtttaaacaacatggctcttagaagtatgtttaccaggtaatctgagggctggttacctggtaacgcaattgagaaatttcatcaagactaattgattaatttattaagcacttattgtccagtttgcctttaattttcatttttctaagtttccattagctatcatggcctcacttgttatttcataatgaatggttacaaattgtttgtgtgtttttgtaattagaatgtaatagcaatcgtctaccagatgagctgacattgtaatgacatgaagtcagtaacaattatgccttacaggaaaattaattctgtaatcctatcatcccatattttgcctaagagattcgatttggctgctgctaggctgcttaggcaggtgacagcatggtgggacacttctcatttttctggttagactacttaaccataacattcatggtgccacctgaaaaaataattttatcgttttagacttttaaaatatttttaggctttttttttttttggcttaaaaaaagaatctgttctacttgggtattttgttctccttatttcttagtgaacaaagatatttgctcgacttctatcccagaaggaccatcctttcttcttccttttccttacctctaagggatatgaagctgtgagagggaattgcatatagcaataccattttgattccagtgaaagttcttacctttctcttttgtcattctcaacctcttacctgaagagtccattccctcagtatatagagcatctggaagtctaaggtgcaggcaggactgaaagagctgagaaaggcctcacatcaggtgacactggggcacctggctgtgctcccttgttggggggtcccttggcctgggcagttttgcgcttctccctgtttccctgtgccctgagactttgtgggtcacaggcaagggggctggcctccctgatcaagggcccttggcctaggagggcccctggatttatctagtccagcttctcgtcgtccaggtgcaaaactgatgctctgagatgtttagggatttgtccaagagcagagttggagccacagtccaaatcttctgagcctagtatggtattctgtcatccttggtttcattttgttctgttcataaaaattgcccaaaactgctgggcaaagtggctcatgcctgtaatcccagctcctcaggaggctgtggagggtggattgcttgaggccaggagttcaagcctagcctgggcaacattgggagaccctgtctcttaaagaaaataattgcctaaaactattcagggttaaaaatttgtctctaagcttaagaatttggaaaaactcagaaaagtagccacctataactccagcattctgagaacagttaagtgtattttcttctagttttttgtttgtttttgagacgggatcttactgtcacccaggttggagtgcaatggcgtgatcactactcactgcagcctctacctactcaggctcaggtgatcctcttcacctcagcctcccgagtagctgggactacaggtgtacaccaccatggccagctaatttttgtgttttttttgtagagacagggtttcatcatgttgcccaggctcatctcaaactcctggcctcaagtgatccacccacctcggcctcccaaagtcctgggattacaggcgtgagccatcatgcccggccttcttctagatgtttaaaacaaacacattttagtgtagttgagcctctgatcgttacatgtttatttcctagcatttaaaagcctttcagcgacatacactccttattagcttaattttttcttttaagagccgtgttcttgctctgtcacccaggctggggtgcagtggtaccatcgtaactcactgaagccttgagctcctggcttaagtgctcttcccaccttaaccttctgattaactaggattacaggtgtgcatcaccacgcccaggtaatttctaaaaaaaaaagttttttgtagaagtgatgcctcgccatgttgcccaggtgtctgtcttgaatgcctggcttcaagcgatcctctcccctcaactctcaaaaggctgtaaccctgattttaatggtagtgtaaagtgacatgggatgaaggaaccgtaacattcttaaagtttccccattgttgggcatttgcattggtcccagttttttataagtaaagaaggctgcagcaaactctgttgtactacttaatctttgtcctttatttcaaattatctccctacaatacgtcccttgaaataggatttctgtggaaaggtatcagtttaaagctcttgacccatatggccaagttgctttccaaacagcttacctgttgagactcggacctatgcttctaaagcctatgtgtgaaatgttcacattgtctttgggagaagcttcccacgaataagaaaaataagggaagaacaaataacataattgtttggatatatgctgtggtttgtgtggacgtctcccaccctttcccttccccagcccaagtcagtcttctgtataaacaacttacataatacagactcttcactgtttgtattatacatgtattttgtgagtctgtgtcagtatttgtttacacgggaattagggcatcaggctgtcttcctagggttcctctgtgcagacttgtagacagtatgggttctttgcgtgctgagttgaggtggccccaaacctttcagacagttgctcagatacctggcagttgctcatttacccttccagaccttcctgcctctatattagccaatgacaagcagatgctttccacaaaacattcgtgtgtgaactgttgacatttatgactgttttctgagcccacaccaggtcatttttctataaaatcagaactgtgagagctcagggcatgtggccatcctggataatgggtcctgctgtctggggagtcgttttcatcaaaattcacttttaaagaatagagtgtttattaacgaaaatatgtgagccttggctgggcactgtggctcctgcctgtaatcccagcactttgggaggccgaggcgggtggatcacaaggccaggagatcgagaccatcctaacgcggtgaaaccccgtctctactaaaaatacaaaaaaaaagttagctgggcgtggtggcgggcacctgtaatcccagctactctggacgctgaggcaggagaatggcatgaacccgggaggcggagcttgcagtgagcggagattgtgccacttgcactccagcctgggcgacagagcgagactccgtctcaaagaaaaaaaaaaaagaaagtatgtgagccttatcccccaaatgtacctgacatgtgaataatatggctcaaactaatgatgtgtataatattaaattgactttgttattataagtgatacataattcaattttagttaaaatgcattatttcaatcaatatcaaatattgcagaaggaaaacctaaaatagtagccaaagttactcagatgagataaagaatatgtttagggctggaaaatcatactttttttttttttttttgagatggagtcttgctgtgttgcccaggctggagtgcagtgacatgatcttggctcactgcaacctccgcctccagggttcaagcgattctcctgcctcagcctcccaagtagctaggactacaggcacgtgccaccacacctaatttgtttgtgtatttagtagagacagggtttcaccatgttagccaggatggtcttgatctcctgacctcgtgatcacctgcctcggcctcccaaagtgctgggattacaggtgtgagccattacgtccagccttttttttttttttaaataaagagggtctcaggctggcgtgcagtggcacgatctcggctcactgcagccttgacctcctctgctcaagcaatcctcccgcctgagccccccaaatagctgggaccacaagtatgcaccaccatacctggcttttttttttttttttttttttttgtattttttgtagagacggggtaattctatgttgcccaggcttgtctcgaactcctggcctcaagcgatccacctgccttggcttctcaaagtgctaggattacagatgtgagccactatgcctggccaataattatataaattttgatataaattcctgctcttcaaggagatgtgggttttttttcctcctgagagtatatttataaagttaattggattttatacaaaagaagcttttgactcatttcatttagcttttaatgttatcatctgggaggagatggtgaagaattctgttagccaaaccatggcgaattaatgtttcttacagatggttttattactttttatgatattatttggatcatgaaacaagtatcttggaaaatgtgagatacaaagatgtgagttgggaggtctctcttgtatgtgagttccttctataacagagaaaggatactttcagtttaagctgagatgctttttccttttcactcttgaaaagtctttgttgcaggaattttctgtgccctccctcctctgggacagatctgcttcttgatactgcagggctccagccttccttccagccagctcatttctcagggaagccttgttttcctttttcagaaaatttaaatgtatatttaacgcacaatttaactccctttcctgttgataatttttttcttcttcatattttgttattaataatagcttacagaatgggatcagtatcaggatcgggaggtaaccaggtctccaagttttccctttcgtttttcttttctgcttttaatgagccttaattaatccagggagctaggctgcagtatctgtggctctccctgatgttttctttctgcatttctgtcttggaggggaacctgaggatttggaagtagagggctctactagtgcttcctttttgtccttttctcattgtccaaaagagtcttaagcgatctccaggaaatcccctgctcctgccaggaatctgcctgtgagtatttgagtgagttgctgctttttaagtaccagttgagaagctgaaggttggtgttgtggttgtgataaactcccaacatgaaaactgaggaccaccagcgttttcagctcacctttgactcacgctggcagctccaggaacactgaacaggagtccccactgaacctttgctgcgttccgaagcagcacagccatggttaggcactgccaggcagctcttggaaaccacagggagggaagttttggttccttctttctgtctttgtttttgagaggaatgagcttggaataaaagaacgctagtaatgactgatttgcaggttaggtgtaaacattaaatcctcataacaggctaatgagaggtgggagaaattatccccattttacagatgaaggaacagaggctcctagagactaaagaacttgctactcaatgaggtcaggattcacacctaggttgacctgaggatagctgctgcagtgctcacccttcctaccttcccaagaaacaatacgcagagaatttcttttctaaatattgtgtgcctagaaggtgctttgtgttatcgaaacagatatatatgtgtatatctggtctctttaaaattctctttaataaaaacaaaaagtgatgctagtgtaaaataaaagatatatatagaaaattgtgtgtcctcgttaatcttctttaggaaagatatatgcatatatgcagtatagttttgggtttttataaaaatgagatcatgctattagtatagtgaatagcctctatatagtctttcgtaacatttttactttttctcggtgtatggatatcaatttaggtcagttgctgcggagtttgaaacgagttaaaatttcagcagttcacaaaatggatgattcatagtttagtcgagccatcatctgttgatggacagtcatgtggtttcttgttttttctttctctgtgtttcactaatgaaacaggattacagtaaattgactcgtgtatgtgtatacatccatctttgctggtactatagaaaagtgtattgctggctgggcatggtggctcatgcctgtaatcccggcaatttgggaggctgaagtgggtggatcacctgaggtgaggagtttgagaccagcctgaccaacatggcaaaaccctgtctctactaaaaatacaaaaattagctgggcgtggtggcagtggaggctgaggcaggagaattgcttgaacccaggaggcggaggttgcagtgagcctacatcgtgccactgcactccagcctgaatgacagagcaaaactccattgcaaaaaaaaaaaaaaaaaaaaaaaaaaaaaggcgttactgccttgttcctgatttaaaaaaaaaaatgggttttaacaaggaatatgttaagttttgggaaatatagtttatcatatttaaggtggggatactcattcatgttttaatttttatcggaagaggctgatgaattttatgaaatgcctttttggcatgatataattgtgagcttttgcttttatttggtggtgtaataaattacgttgattagatttcccaatattgaatcatctttgcattcctggaataagccctaatttgttatggtgtgataatctttggatatgttgctatttgatttgctaatatttttttaaaaattgtgactgtagcctacaaagccctacagataggggtctttagtttttttccttgtttgcattctatcaggtattgatattaggattatgttttttaaataatttaagaagaatttcaccctttcccagcatctagaagcatttacataatataggaaataacctgtttttttttttttttaagttagagtaaaattaactggaaaacttcataggcatcccctgtagtcccatcccagaacattttaaaacaaattttttagtttttcagaatatattatagttgttctgttcagcttttaagccttttctctggattttgatattttctacttgctgggaaagaatttatctacaatttgagtttatcgcacagttatttgtaatattgttatcatttctctggtaatcataaccctttctcattactaacacatatttttgctctttttttgcttttttcccccttaatcaagtttgttagaagtttatatattttattgtcttcaaaaaactaggtatattaattttatatttatcctgcttttaatttcatctcagtatttaatttttattcactttttccattcctttaagtttattaagttgaatgcctgtctcatttgctttttagtcttcttaaaataatggcatttaaggctatacattttctttgaaaattgcttttgttacgtatttttggttttagacagttgatctcctttttgttgttttctagatggtttgtaattaaaatatttatttgatctttgattctgacattacttagaagtatgtctgtccttgaatttttcttttgcttaccttttgatattgtttatatgatttatgaatgcagctctgaggtatctgagaggatttattaacgtttacttgcgtccaagtacatgattaagttttaattgctttgtggacattaaaaaattatgcccttggtaaaatgcaaaggttttattttctgtatttagtaaatcaaacttactgattgcattatagtcagatcttccaaattcatgtatgttttcagttgtcaaattgacagttaatgatgcaccttttataatttttttttttgagacagagtttcactctgtcgcccaggctgtgtagtgcagtggcgtgatcttggctcactgcagcctctgtctcctggattcaagtggttctcctgcctcagcctcctgagtagctgggattataggcacatgccactgcacctggctaattttcatatttttagtagagatgaggtctcactatattggccaggctggtctcaaactcctgacctcaaatgatctgcctgccttggcctcccaaagtgctgggattacaggtgtgagccaccacaccgggccccttttataatttttaaacttttcatatttccaagagaaatgcttagtgtatttatctgccgttttgcttgatgcatcaatatgtgtaatttttttatttttcagggattacatatttatcacatgtaatatccctctctgtccagtttaatgcttaatggccttgagttcttggtttgattttactattgccagctttgctttctttttacttgactttgcttggtatactcttgttcaattgtttgtttttaaatagagctggacttttaaaacccattgagacatttttgttctctaatagggacgttctgccttgtctttctttactgtgataatgcatacattttgctttattgctttcatcttattcaatggttgccatttattttactttctgttattctcaattcccatgttaattgaacaagtcctttgctaatttgaaaagtgtgttattttcaaagctaccggtgcctaacaatttgaaaatctgtatttttctcctgaaataggtaccagcattaaattactaattcttccaccagggtttgcatttccgcaatttctgccgttcccatgactttctctgtctcctggatgtgttctctgtcttttcactcatggattctagtagattcttattccttgctcttgggcgctcgcatttcttcttcttaatcctccagaatctgatactctagagcaacagatcttttctgttcaatttaaaattttaaagtgtttttttttttttaattcctgaaagtttttatactccaattgtgtctccacatatgctcttagactcctcttcccgtctagttctcctttcttggttcaattagttctgtttcagctggtgccacctgttgcagctgagcttggtcaccctccctcaggctcctgcgtcgtcctcagtgggtcatggtttttctttgcttgccgatggctgccctcagccgtcacacaagtcatgggttagtgtcactcaaggaatggcagaccagcagatggtaggtgataagccaggaaacagatactgtgccgctgagttgctctgttcccagtctcttccgacaacataaggcttgggaacagttccaccttccatggaagccccccttccctctggtttcacctgggacagcaggatgagcagggtgcagggccttcttccctgtggatggactctcagttacaatgaccatggagaactgtacccgctctctgttttggagatttgggagatcctgagggcctcagaaggccctcactctcatcccatgcactacctgtaagctcattagattactgtccttgttactttagagaggggactgtgagggaggcaggaccaagtatgtttattcaggccactgtcttccccataaagactatatttgtgtacatttttctttgctgtattgtgagaaggaggtagaaaaaagatgtgcatgtctgcatttggaaacagttctgagagtggtgctgcatcagcggggctggattgccctcaactataagaaagtgggatacttatataaaggaagcataatacagcatgtttctcttacaggaaggactgtttcttagagtcctcatcctctgtctccatcactcagtatagcaaatcatacattccatcaatgttaatgacatcaattgtatgcctgtaagtatgtacacacgcacaggggcagggggcacttcttcactccacagctggaaaacttgggacaaaatgcctagccagcttggcccaaatttgagggtattgccatctgtatctcagtgcaggtgtttctgtctgatgttcacagtctgtttatccagagtgccccagaaaggacagtagtgttaggttaaacctgtgtatgtctgttcttggttttaataacagtcctgtctttggaattatttagtgtgttctctcatttctcaggaagtcaggatgttagtgccgaagcacttctctgacttggtccgacattgaagtaccttcccctgcattacagaagaacggccccccagggggtctgtttgatgaacacatgtattattgcagtgagatactctagaaatagcttcatgtccttgcaaaattgccagcacaagtaaggacctggaaattgttgctatgcatgtatgtcagaagatttcttaaccaattctgtactgaataaaataaaatttattttcaagttttgtagggacctggggcaatatgtcagatagagttgaatattttcaaggcatttttagttcatggggcacatagttggcttaagatatctatgtgtatcaggactgaaaggtaaagtgcccgaacctgctaatgaaagaggtgtctgtgtggccatctgaggttcagccacaatgtgtcttgcagaattattttattttgctagtttttaatttctcaaacagttcagctgcctgtcccgtggtaccgtgagacttctaattcaagatgaccagtatttgcagacagagccactgcctttgctgccacattttgcttggttattgtgtgagaacaccatttttctctttttaaatgaattgtgtttctctttttaaattgagcatctgactgggcgcggtggctcacgcctgtaatcccagcactttgggaggccacggtgagtggatcacctgaggtcaggaatttgagaccatcctggccaacatggtgaaactcctgtctctacttaaaaaaaaaaaaaatggaaaaactagctgggcatggtggtgcacatctgtaatcccagccacttgggaggctgagggcaggagaatggcttgaacctgggatgcggaggtcatagtgagccaagactgtgtcattgcactccagcctgagcaacagagagagactgcctcaaaaaaaaaaaaatccgtttacatagtgataaataaagtaattactatagtggtggcattctgcctaagtcatcttgaaaactgaatgcaaaatctttttaatagctccataatggtctcttgaagtgttacagatttttataacgatagctgtaatacaagtgcctttatttactgtgagacttgaacattttgaccatttacatgggtacttgtgtgtctccagctgagctgagtgcatgtcgctgcggcattgcaggcgtgtgtgcatgttggctcttgcaacggggcgtctgccaggggttgtctcgggcaggagaaggaggccagactggcaccacttgtagtgattggaatgtgtctagtccagctcttcagttccatgtaggaggttttaggatggagattgtgttttgggaactccaagtcactgtccaatttggagagtattatgtaagaaggcttatgttttctgattacccatccttcgatacagaccaaataataccacagtgataaaaatgggaaaggagctgtcgctcagctcttcttggccgtgttgtttgcttttcgatgtctaatttatgaaagcatttcaaagtgacatatatactgaacagcttcgtcttgccaaatgtaaaataaactggagatgagtttagcacagagctttgtagattgttgtcctcttggtagagtcggggcctaaacaccacctggcctctgtgccagtggacaggtgacctgcctgtcctactgctggtctctgcagctctctgtcttgggcaaccctggctctgagttccagagtgttctccagtaggagagtctgcaggggcactgtggagcacctgggtatgtgcacatctgttgttggctggcgttgtctctgatggcttggggtgtcacagagacatgacagtactgtcactgcatacctctcaagcttttgctgagtcctacatgagttgcaggggcagagagggagggagaaaacaatgcctagccacactgagaaaggggaaagtgctacagagtcctggaaggaagcgaggatggacatggacggggaagcattcataccaggcaggaaaagtgacttcatggaccagtcacagaggacagggccagggatcaaaccttccgtaatttgcctccacagtttgtctgagactggctacctggttgagtctgccagagccctgtgtgcaggtactaccactcactgtcacctccaggcaggaaaggccatgtgaatgcatgcatctttgcaggaacttgcccctttccactgaggtttgaggcagactccaaccacatttccatccagtggcttagtggtcttacccgtgagcttgaactgttgtccctgccaggacagtctttgcctctgtaagtatctccatattcctccatcctttcaggtcccattcagtccctaggtcctccatgatggaatattggttgatgcacttattccacaaacatttgttggccacctttcaagtgccagacaacccttctaggtatggaggggtacagtgatgagcaagccactgtttctggctgcagagggctcactgtttagtgggagaaacagacaaatcatacatcttaactacactgcccttgattgctctttacctgttatatcagtcgatcttgcctgcctagcatttgttccctgtttgggggcctgtatgatgttcgtttggatacctcagggtacattttcccatctttgtgatgatgtagctcacttggtctgaatgatatgtaatcctgcacatgtagagtgaccattatatttgcataaatagcattggaggaatatataagaaatgaataaaagttgttatatcatttgatttttcttttcttttcttttctttttttttttttttttgagatggagtctggctctgctgcccaggctggagtgcactggcacgcgcatagcccatcgcagcctcaaactcctgggctcaagtgatcgcctgcctcagacttcattttgatttgtgaacctcgtgattctattacttgttccacaaaaaattttaaatgaaaaagtatttcaaaaatacatatattccggccaggcatagtagctcatgcctctaatcccatcactttgggaggccaaggcagacagatcacctgaggtcaggagtttcagaccagcctggccaacatggtgaaaccccgtctctactgaaaatacaaaagttagctgggcgtggtggcacgtgcctgtaatcccagttactcgggagactgaggcaggagaattgcttgaacccgggaggtggaggttgcagtgaaccgagattgcatcattatgctccagcctgggcagtgagtgaaactctgtctccaaacaaaacaaaactaaaacaaaaacaaaaacaaaacaggctgggcacggtggctcatgtctgtaatcccagcactttaggaggccgaggcgggccgatcacaaggtcaagagatcaagaccatcctggccaacatggtgaaaccccatctctactaaaaatacaaaaattagctgggtgtggtggcaggtgcctgtagtcccagctactcaggaggctgacgcaggagaattgcttgaacctgggaggcggaagttgcagtgagctgaggtcgcaccactgcactccagcctggcgacagagctaggttccatctcaaaaaaaaaaaaaaaaaaaattcctccacaacatatattccaatgtttagtttttctgttacagagatcacatgtactctaacttgtcaactaaatttaaaaggaaaagacaactttgagagaaaattaaaaccaatgcagtgtgtgtaaatgccattttgataagctcttatttcatgttgacatattctatggtgctcgtcttacataacctagttagggaaatgttttgttccagtctggctttgtttttcttcatgtgtttaggtccttccactttccttttgttaatttttggtgttgtacttcaggaaatgaattgagggttgcaaatgacctggagggccttagtttgtttgcttgtttgattttagcaacagtcaccgtggtacacctgacgtggctgggactcctgattttttttttttttctttttgagaacaaagaatgtgtccttgtcttggcatggactgggtagccttgttcacctccccacccatctctccttattggtgaggcattgtaaaccgtgttaacaggtagcatccacagaaccctggaaaggttgtgaagtccctttggaagcctaagggttttgatctcatccaggttgtaatcttaaattctggtacaaattcccttgttacaactgggttaagtggttttaacctcttttgtgccttcattttgaatgcttagactggaaagtcgttcagagactcctgaccgaataaagcctacttccaaatgagtgggttgtccaggtgtgcttgtagatgtcacatacttctaacaaggctctgcagctgcgatgtcaccttgcccagcgtgacctcattagcatgtatgtggctttcagtggccatgtactttgcttctagagctttctttcccattctgggttcttaggagggggctgtgctttgtgtgtggccaggcagaagtccatgttttagcttttcaattctcttgaagaaaacaaatgttgttgataagaacacttgtcatggcatccgatttgttcttgtgagggctgtattagcaataaatagacatttagtttgcatatttaacacctcatcttctttcagcccacacgtcttcactacaggattagcttttcattacttagtagagcttttaattacctgaagctttcgtgtctttactgggatataacttttctccttattaaccagaaaaagtcacagaaaatcttgtaatttataatggaatggagtaatattcacaaacaggctttggcaggattttttttgttattgtgttttttgtttttgtttttttgttacactagttttatcacaagacaagaaagaggggaacttttagaaataaaaattatgtgctaaaataattaaccttcctgagtaacacacacagaatgttggtatagtgtttgcaccagaggaattacatatggaagaatgctgggatcttttaccaaataagggaaagtagagttcattacaaatagaggcttctagcacagaaaagaggacattttataagtactgtgaagcattttcagagataattaaataatagaaaatattaaaccaatttaaacaatttgtagtttttttctaataaccagtaagttcttcgtcttcgaataattcttttatactgttctatttccagctccactgagtgcccctgtgttttcagagaaaacaggagtctgttttggacttcctctttggtatatatggtgggagatttgtttaaaaaatttttttatagaggtaaaattcatatgacataaaattgtccatttaaaggtgaacaactcagtgacatctagtatattcatactgttgtgcaattgccatctctatctagttccaaaatacatttgtcatgccgcaaggaaagcctgtaccccttaagcagttaatccccattcccctttccgctcagctcctggcaaccaccagtctgcattctgtttctatggattcacctattttgcatagtgcatataaatgcagttatataatatgtgaccttttgtgtctggcttctttcacttagcataatatttttaaggttcatccatgttgtaatgtatcagtacttcatccctttttatgggtgaataatagtccattgtatccagttgtatccagaagatttgcttttcattgcctaacttcagggcttcagacacctcaatctttgttctgagatggatgtaaacttaatgtatatctctctctctcacccaatgatcatgccaacaccttttttttttttttttttttttttgagacagtctcgctgtgttgcccaggctggggtgcagtcttggttcactgcaacctctgcctcccaggttcaagtgattcttgtgcctcagcctcccaagcagctggggccacaggtgtgagccaccacacctggctaatttttttttcttttctcttttttgtttttgtagagatggagtgttgccatgttggccaggctcgtctcgaactcctggcatcaagtgatctgcccgcttcagcctcccaaagtgctgggattacagacataagccaccttgcctggccatgccaacaataattatttagaagtatgttgagaatacatcccaataatagaagtgaaagctctttaaaaagaaaaatattcaaaacttaccagctgatcttatgtttcatttagaatggctgcattctttgcagtaccctagggttgtagaaattctcccccatgattgcacaacccactccttctcagccagtgtgcacctggagtcagctgtgtttggccttaaggtgtccatggtccagcagggagagggcagatgggtcagtgttgtcctgctagtgatgagtatcccatggtgggcatgctgatgccacgcaagggagagggtgtctggttctgtgcagtggcagtggtgcaaccccttaccaaggtaccgtggggacctgggttagggcaggaggaggaaggtgttctctacagactgcagggcttggaggcagcctgtcatggggaagggtgtggatgaagggtgagccgggaccccaggcaggtacggagcagttcaaggccgtcaagtgtgcttcattcttcagtcattagggtgtctctgaaaggtttttcattgaatcagaattcccctaattcacgaattctaaagcttaagtaaattcagtaataataaactgtcaattatccaagcgatgaatataaatccataaggtttttcaaatccccagaaatccctttcatctcccacctggttttgctgagcgcctgtctcttctgtctcttttctgattcccacctttcacttttcctccatttttcgcttaatggatttatactttaaagtaggtattctgaaaattccaattttatgaatggtgtgacggtgagaactttgattcattgaaagataaaaataatcattacattttatactgcaagggtcatccttaatattcttcgtatttttaatatagctgcatgatttgagtagttgagttggggattggataatgtatttattgattgattaactctctgggggtccatacatacccctctttatatccctgtggtccctttttagtccttttgtaaaaacttgataatgttaacctctgccaaagttgatgcggtagttgtgagtggtgggacgcaagcgtgttgatttattcttggagacagcagaaacagcaccaccttcaactgttttgtcatgatcatcttgtaaccataattctgtgctaagtcagaattaatgttattttgttaattcaggttattgtgaaaatctccacaggaggttatttaagcaagtcacaaattgatgattctgtttgtagaaaaactccagctcatccagccagccacattattccagggctgcatggtgtcagcgtagggaccaggctcggtgtagagaccaagggtgcctttccccttcctttccgcccgttaattgcctactcgcccagtggtaccttctgaacttttagaaatccagataggatttccacatggttcattagaattcatttatttttttccatctgtatttctttttgttgtactccctagatcattatttttagttactttttacatgcattggttaggtttttcatgtaatctctcagtaagcgtactgggggatgagtgacctcagtatttaaatttttcataggtgggatgaaatgtcttttctgagtgtgagtatttctgttccattcttcttttccaggcaggctctcattctgtgctgcagtttggattcagggagcactgacccttctgtcaggttgctcctgctatgaaggatggaagggcattttgatacatgaggcataactgtaattatccggtggggcttggtttgtgctgttttccacctcttcgtcatattttggaaaactgaggccaaaagcaaagttcattttcccctttaaaagcttctttaaaaaaatgatgaaagagctttatcaatgttttgaataacccagaaaatatttcttattgttgataatctgcagtttgcaagtgcagcgaatcttgtaggtagatttaccttgagttttttgaaacggtagaattaatatattaaaacatatggtttttagttaaaataggatgttaaaggaatagagcgcacgaacaaagaactttccacttgaacccatgttgtttcatctgacagtgggtatggtgtccctggcaggatagggcttccacctcctgctggtgccggtaggacagggaagaggtggggaacactgtgtctccatctcccaagcatcttacctcccaagtcagatccctggcattgtttgcatacttgcgtgtttgtgtgtggggtgatgttttcctgagaatgtggcaaaataatagaaggtcccagggttcctcagtctgcagaccatagctgagtggtgtgtgcctctagccatgaggtgaagcataggtgaaattcagatccataggaagacagacagactttgcaagttagtaagctaacttgctagaggaaacggtagactcctgtgctggctgccaactaaaaagcctttctccacagttctgttctcatgtacaccctcaggaccttggatgagcttgtgtgttcaggaaattgggcaccgagattttttttgtatctttgattttagttgatatgtagtccttccaaggaaagtattcgttggatgccctttctacactttggcattgtgcaagaggtatcaaattttaaagtaaaagtgcacaacctggccaggcgcggtggcttacgcctataatcccagtactttgggaggctgaggcgggtggatcatgctgtcaggagatcgagaccatcctggccaacgtggtgaaaccccatctttactaaaaatacaaaaactagctgggcgtggtggtgcgtgcctataatttcagctacttgggaggctgaggcaggagaatcactttaaccagagagttggaggttgcagggagccgagatcgcaccactgcactccagcctgggtgacaaagcgagactccatctcaaaaaaaaaaaaaaaatgcccacaactgggcatggtggctcatgcctgtaatcccagcactttgggaggctgaggcgggcagatcacgaggtcaggagatcgagaccatcctggctaacacggtgaaaccccgtctctactaaaaatacaaaaaaaaaaaaaaaaaaaaaaagccgggcgcggtgccgggcgcctgtagtcccagctactcgggaggctgaggcaggagaatggcgtgagcccaggaggcggaggttgcagtgagcggagatcacaccactgcactccaacctgggtgacagagtgagattccgtctcaaaaaacaacaacaacaacaacaacaacaaaacctcacaaccctggtctcccagagcttccatattaataaatctagacaatgtgaaatgcaaatccacttaatatttgatgcaaaaaaaatttatttgacctgttattttaactctttgacataaaatctctaaatcaaaataatcagcaacagttttaagtgtataaatatgtatttctttcagtgcttgaacatttttagacaggaagattcttgatcttctttgtaagcaaatagcatcaaagagtaacatttctgtacctttgtggtatgtaccttgtggctaatttgtccatgaagggataggcattgtgttttgttgcttaagtcgcttaaggcctttaaagcatttccaaactcacctatttttgctctaaggggtataaggtgttaaaaaatgaatggaagttaactcattctcaccttgtctgctaacttccttttgttctttttctgtaagaactcataaagctgtatgcatcagctgctcccaggggccttctaaggcctcagtccaacaacagtgctacaggtgaggaaaggaaagaaggcactatgtcatcatgtcattcttttagacttggtaagaagtatattcaagcagatcagatgctctcagaatcacagcgtgttgtactgctagtaattaaaactgaagtccacgttgaataagaaataattttttattgattgctggcatttgtgagaaagggtttaattagaccaggatatggaggggacttatcgacagttccgttgtacattgttgacatggttattttctgtatctcattttgcctgggaatttgtcattctcttctattttcttatcagtagcactgcttttacacttattagccctagctgtttgtcttgcttatttaaacttgtacatggcacatgctcaaagatttttccaggcaaaatttctttaaagcaggatttgagattttccatccccttccgtctgctggattattccggtgagtgttaatctcccgcctttgtcttagcctctctgtggtcttcggttgcttccttgttctctgtagatctcctgagttggccattagctgtcaacagtcagcacttgctgcctctcaagtctcttcccctcctggctctgccctggttttgctctctgacggggatctaaattgggattctttccagtgtggaatcctgggtgtccaccatgtcactctgacttccagatgataatgagtgtgaccatgggctgaatgaatgtctctctgctgggattaaaagttagaggaaggcaaaaacagacattgcgtgttctcacgtatacgtgggagcaaaaaaagttgatctcttggaggtagagagtagagtgatggttaccagagactgggaaagggggcgatgaagaggggtagagaatgagtacaaacattcagttagatagagggaatacattctaatagggtgactatcgttaacagtaatttactgtatatttccaaatagctagaaggttagaaatgttcccaacacatagaaaggatacatgtttgaaatgatggatatcctaattattctgatcattatacattgcatacatgtttcaaaatatcatattaaccccataaatatgtacaaatatcacacatcaataaaaaataaaggggaagacataggtgtaggcatagatttttaagctgagaaccttttgacagggaagaccagggatggttttagggtgtggggaatctgtgtaagttggccgttagctgtcaacaggcaacaatcactgtctctcaggtccctcccgctcccggccgtgtcctggttctacttgccggcagggatctaagttggaattcctttccaacatggaatcctgagtgtccaccatgtcaaaattgtgtcaaaattcgtctgtatgcatttttcttggtagaagggtccccaaaagtcaccacattctcagagacttctgatccctaaaactttagatcaacagtcaataaaaaggtcccagttgtgtcttagtccccatggcagtacttttgaacatttaaaggtggagaattgctactgaggactttgttctgtggatgaaacttcgaatgaggattgttggtgagagttggattgttgttgtatgaggaagtgcaccttggaatctaatggggtcttcacggagggggagtcagttgtggcactgtttgtgtattccattcatcattcatccctccatccaagcacccacgtggagctcagaaagatgactaacacataccccctgctgctcctgtttttctaaggtgtgctgggaccatttacatttagttctttggagaacacaactacttaggatttttgttgttgttgttgttttcctgtacattgtcttcctatctcccttctggtacccattccaccctctctccccttcctcactgccgtttcataggggttctcagattcctgtgaataaagcaaaccgatgtgcagatatgtgtgcttacacatgtggacgtatttgaggaggtaagagggacctgcacaaggctttagtgagtaagcagagaagttatttatatatagtgagacccagtaaacggcgatgtcgcaggtgaggcagttgatctggtcagaatatgcctccagagacatcactggtgaggcctgcatgcatgttgaaaagagtgtatcttacatctaggcttgggtttccccctgcagctcacttatgaataacaacgtatgcaagagatttgaacattttcatgttcaaatgaaacatgaaaagggaaaaaaatttaaggttacggttaagtttggattgtttgcttattggtttggttattggcaattgctacaaagtccagggtgttctttatcagcagcatgcttatcaagttactgacgttcaagctgagtttccttccctccctccttccttcttctccactgacattttttttttttaaataggtagggaggcatttaatcttgtagcagcatgagagtagcttaaatgtccctcctctagcagtatgtttatagcagcgtaggtaaggaaagcccagcttgcacagctgagctctaaagtgcatacatcccttaagttctcatacacacactggccagtgagacccccaaactgcgaacagagaattctaattgaagtaaaagcatgaagtttttctttattgaccatgtagcaactgtggaatcatttgaaaatttctgaaaacatgaaacaggtgtttataaggagttttctgacttaacaaaattggtgaaataccaactttactaaaaactactaattcataattttttgattaataatttctagtctggaaaagaggaattttttgaaaatcactgatatttttgatatactgttgttttcaaattgagttctcatagtgtggtcggctctgttctatggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcatagctcactgaagcctcgaactcctgggctcaaacagtcctcctccctcagcctctctagcagctagaactgtatatgtacaccaccacgcccagctaatttttttttttaacttttttttacttttgaagaggtgagattataggcactagccactgtgcccagccaaaaggtcactttttttttttccttgttggggaggaatcaataacaggaacaccagtcatgatttggtgttttttccagggcagacaaataaagatgatattacgatgtttgttatcacagaatatgtttgcttttgataggggttgggtgctgaagggtaagtggttagaatcattctttttctaagggtacagtcattaatactccttgattcaaatcactatttaagttataaatacatggatttattttctaacctcaaaattatagcatcttaccacatatttgcatgcctctcttgagttaactactggtgatgattcttagctcatctgtggccaagtatagataagagaattagaaagttgtttccagcgtgtgaacttttatgattttcttccttggttactgtactcagttcttttttgttttgtttctatacaagatgagtagctggtggctcagatgacccccgtgctgcatgtacagtcccatccagagagtgttgggggctgtgtaaacctcgaggctcagagtggctgccattttcctaaaagagaagtatggctgctgttggcctcaatgttcagctttacaaaaattcccgtaattaatgaaggtcaaggcatctgcaaacattaatggggtcacaagggacaaatcagttccttgaggggaagttaaaatgctagattgcttaccgctccagacaaggcattctcaagaagtatgtgcagtttcagcacaaggattaacacggagcattacttgagccatggggtgccttgggggacatggatcagcaaccatttccttttgctcacagcgcccagattttgttctggggaccactcttatctgcactgcatagcagccacacattttgagtgaaattaaccccaactagcattcgagcgtcctcccctcccccaaaagatggactgtaccccacactgtaatcagcagggaggcatttcctggccacagttcaggttggtcccttagaacgctgctcagaactgtggtttggtggctctgggaagcagtgctctctctgagtgtgaataaggatccacatagctccagtaggtgtctgacgacatcttgtgatccggggggaagccagcctaaggacaaagccattgtggggtgagagacaggattggcacaatcactgacaaccgcagtagtagcccagaataaactgtgcctgaaacctaccctatttttgtattttttccagttttaaggaaataaatcccctttattgtatactcagtttgaatcaattatttttatctctttgggattggtttttggttaatctcagcaattcagaaatagctgaagaactatgctgtgggtttagacatcatgccgtgacaaaaagaagaggatcttagaagcgggggacattcactgaagctttatgagcctttcctgaatcccttcaaatcagatcaagttctctctctcctgtgcttagaaatgctgcctgttaagtcacgttggctacagcacccatctcagatcccttgtgattcagttgtaaagtagattcttctggtctgaattagaggccaaaacacaagacagatcaaaaatggggaacatattgcaaatttccccacaaaagactgaaggatgtgtttaccattgattgcacagggactgcagtgtctatgcttttaggcatggaaaatgcagggtttgactatcgagtttagattttaaagttgaggattgtttctttaagaagaaatatagaatattattcagtcctaaaaaggaaggacattctgacacatgcaacagcgtgaatgaaccttgaggacattatgccaggtgaaatcagccagtcacaaaaggacaaatactctatgtgatttcatttagatgaggttccctggagtagtcgcattcagagacagaaaacagaatgatggctgcggtggtgggggggtggggggtggtttggggaagggagtggagtgatggtttcacttttgcaagatggaaaaagttctggaggtggctggcggtgatgttgtacaacagtgtgaacttacttaacattgctgcactctatacttaaaaatggttaaaacggtacattttgttatggatattttcccacaattaaatttaaaaggaagatgagtagtactcgactcattattggatattacatcagggaactggaggtagggtctcacttactagttacgtagctcaggaacctggaaccagactccttctccagctgggcagtcccaggtttgagtcctggctccactggaggttgtctgacttggaggttaataataacctgccttagtcccagagtccttagagggaaaataggttataatacctgagtccatgtgtatcaagccattgctggttccaggcccctggagcactcagaaatggatgacccccagctgggtcaggccaagtcctccctgctgtagcaagcgggaccattgcctcgttccccccacctccacatggaaggtgccttttgtgtcctgccccatctctgttttaacagtcacaagactgtaggcagatctaaacttgtttgcacattattatcacctggggagctttgacgattccaaagccaggctgccacccccacctctagaccaactgaatcaccatttccaggggtgggactgggcatccgtgttttcgaggcttctgggtgagtaccttgtgcaaacaagttcagggaccgttgccctagacactgttcttcccctcatgtctcaacctgggcctcctaccactgccaccaccacagctatgccacctgggatgtgtcccaagcccccacttgtcggggaagcagctggggaggggtctttggccacctctgcagctataaggatcagagcaacacctggcttctgtgcctgtggcccctgctggtgctgggtccctggtccgcactgaaggatccaggcagagtacagtgggtctcccaggtcagaatcccctgggttgcttgttaaagctcacagggctgggccccaccccagggtttccgattcagcaggtctcgggctggttggatgatgagaatttgcatttctgtcaagttcccatgtgatcctttttggggtctgggaccacactttgagaaccactggtctattaaacaaatctttgcaaattagggaggtgtgttgtgggaggaagagactgatagttgaaagaatatttgcctaaatacagtgcctagtatttgccaagtacgcagccttctttctggctttaatcatacagactttctcaatcacatgtaattgcacatcctttaagcagcttttgactgactttggttttctcttttgtggtgattttccttaaactcccgaagggagggtggaaggggcaagagaaatttttatttatttattttaatttaattattttttattatttatttttttattttttttttgagatggagtcttactctgtcgcccaggctggagtgcagtggtgtgatctcaggtcactgcaacctccgcctcccgggttccagcaattctcctgcctcggccttctgagtaacagggtctatgggcatgtgccaccatgccgggctaattttttgtattggtagtggagatggggttttgccatgttggccagactggtcttgaactcctgacctcagatgatccacgcgccttggcctcccaaagtgctgggattacaggtgtgagccactgcgcccagccagattttatttctttaaaaaagaaacttactagttatcaggacacttgtgttcttggtacttgattttgtcagcattatttttaagagcctcttccctccttccccctacctccctgttgagcccaggctctgaaataacataggtgcatgtgaagttcccctacctgccattaccagacattggtgctgggcggccctcacctccacctcctctcacctgaggccacagcggtgtgcaaggatgtggtctgtcttgagtgtgttttcaaagcagctgtttggtctgtgccttggatgtttttccacagataagcccaaaagagaaccacatcttaaaacgcccgtgaccttgaatggtctttccggaggggcggctggatttgtgctctcatcgtctcaggtatgtgtcaagccactgttgtttcagagctggacacaggtgcttaggaaaattcctcactgaagggttttcaggatttacaagttcttgctgtttttgtgaccttgtgtggtttctggtttcacagaaggctttgtttcttggttcttgttgctgctttcagccttggcctgtaatcactgggcgccagggagggctgcggtctgtttcccggggtgtgctcagataccgtgtcagttcacatgtgttgctgcagcggcagggggccaggcaggaggggcgggtgtcctgaagcacgctcaatttgctgatcagggccttcacttggattttgcacttgccgcagtggagacattcctcgtagctactcagtgtggtttgttttaagtgggccatccgttaattcatgtgacctggaacttggttaatgtacttgccaaggttaaagttgagacgctgtttgttaaacctttcaaagagggaagaaggttgccttgaattcagttccagggtttgggagtctgagagggaggtggtgaggggcccggggaggccctgagaaacaaaatgctggttaaggacacagtctgctcaccgacctcggaagtctctagacgtctaaagaagtccaagcaaggaatgatgaccgaagaggaacctcaagggtgcaggcggctctgggatctcagcacatctcagtgatggaatgagctgccggggaatgacccctgtgggggctgtccaaagtcagagcagacacaaacgtagctctccaggccccataccttggtgggcaagagggcagcaagtgcatcctcacagttgatggggagagcagcatttcagcctgcagaaaagagaaccacacagatgtaagatgaggtctgcactcacttgcctggtcatgcagagacggagctgggagcagctgcatgacttttcagagaagtggcacacgtttactgtaagggtcccaaatgtagaccactgcagatggtaaggtctagatggagggaccaatagtagggaagtaggggagaagaaagtaaaaccttacagtataaagacccatagatgctcttttgtttttgatgtgtgtacgggggttagatatttattgagcacctactgcatgacagagtgttcagcaatgacaatgcagagcttaataagaacaggttctagactaatcttttagggggtgaggatagaacagaaataggtaattatgtcctgagaacatgagagagtgttggtggacagaacggcgatgtatccccaagggcaactgaagccttcacagaagatgcaaagcctgtacgtggtcctcggagtcatgccacatggtgactggttatcttagtcgtaggaaaactgagaagctttgaggcatgttctatctgtctttgtgggcatcatcttcattatttgaacaattcagagtgcttgatgccttttgcttcgttctcacaatccttgacactaagctgtgggcttgggttatagtcactcattctgttattcatgtcattttgcctatccttccacttcacagatgagaagactgagacccagagagggtcatggttttcattagccaaatggtgcagaaacccagtggtcacagtggctctctagctctttgtcacccacagggcccttgataagagtacggtctttctccaggggagcagggttgaggagtgggggcagccctggcctgggtggccatatcctgatttcccctcccttggcccatagctctctatcttgggtgaggtgagaaagtaaggctgctccttgactgtggtcccttttgtgtctgtcctgcactgggccaccttcccaggggccttgtgtcagcctggtagtggtgctagtggccttgaagtgagagtgggtggatcacacatggcagatctctggcagtgaccttttctgtggatttccggtgactgatgatagcctctttggaagtcagcatatgcatagctctctgtcttttgaaaacaatggaaaaacccaccaccagccccaaaaccagctgtctttcttcttatgaatagatatccatgaaaagcagaagagtagtttcttgtaagtactctgggagtgcataatacattttaaataagattaaaaattatgttttattcttactagcatcactgtcagataattgagcgtgagagcattcagtgctgtgtgcttggtacgaagtagtaacatcaattcagtgttcagtacatccactttgttccagaacaatgtattcaaggtcggtgtattttggctgtgccacagagttctggaaattcccaagagaataagttttcacctgttatataatccagcacaagtgactgtgtagcagcaacctcatgtttcatgatgactttaaaatgcaattgattctaaaatttagcttttaaaaatttcgacttcagattttctctgaaggtttaaggtaggcttctcctttattaattttttcaagaaatatttaagaacactgctctgtgctatgtaccattctaagcactttacagatactaattcatttaatcctcagcctggttaggtaagtactgctattcccaccgtacagatgaggaaacagcctcagaggagttaaaacaagttgctcaggttacaccgtcagcggtttggactacttcagtttcagataatcactgtgaaattttactgttttgagctacacgtttcaaaatcttttctgatgcggaactatcattaaatcatataatccgcttctctggagtcagaggttgacaacacattagcacttgactcgagcctctccctggaggaggacattccgtctgcggggagccgagtccgaggctggagcaactctggaaccacagccctccagtagagggcacacgagagcaggctatctgtggagatatcctgttggcacaggggtgaagatgacagaggcgaacccaagcaaagagagttaattagcagagtttgccctccaggctcggagggcaagtcagcctggggacctggagttagttcccttttcagctgtgaccattgaagacattcatcaagttctctggctccgggatgtcagctgtggtagtgacttgcatgggaggttatccgacatacctcacacactttaactccacctcttcagagtttgtggccaagaatggagccaggtggctattttttttttttaaatttatgtaataacaaacattcgcatttattgaaaacttaaagtataataaaaaaataaataaaataaaaaaagaaaaaagaaaacttattcctgtgtcaggcacttttctaagtgctttgcagtgtattgtctcatttaatagttgtttaaattaacagagtaggccgggtgtggtggctcacatctgtaatcccagtactttgggaggctgaggcgggtggatcacctgaggttgagagttcaagaccagcctgacaaacatggagaaacctcatctctactaaaaatacaaaattagccacagtggtggcgcatgcctgtaatcccagctactcaggaggctgaggcaggagaatcgcttgaacccgggaggtggaggttgtggagagccaagattgcatcattgcactccagcttgggcaaaaagaatgaaactctgtctcaaaaaaaaaaaaaaaaaaaaaaaagagagtaaataaaattgtaaggtgaatatgttatctacttgatggaattttttaaactaccttgaaaagttttatagtttcctatttacagatgaaattaacatactaattataaatcatgcctcactattcactttaggcagtctatctccttaaggatctccttacggtttagatagataagtgaattgcttaatgtttttggaagtaataaaactgcatttctttttaattaaacaatccagataacaagaagtaattctaataggaaacttgtaggatgtatttacagaaaatctacacaatcttactgaacaatgtagaaaagaagatttaccagcctgggcaacatggcaagctttgtctcttaaaaaacaaaacaaaacaaaatttagccgggagtcgtggcatacaattgtcatgtccacttctcaggaggctgaggtgggaggactacttgagcccaggaggtcaagactacagtgagccacatttgtgccgctgtactccagcctggatgacagagcgagaccctgtttcaaaataaagaaaaagagatttaaatgaagcgaaatgccattttctctaggtgagaaactggaatattatcaatgtcacttcttcccaaattgatttataatttaaaaacaatttcagtacttctgcagcttgtttggagcttgataaaatgattgtagagtttgtcttgaagctttaatagtgaggcaggtttaaaattgggggcaaaaaagaaatgggttttagggtgtagaagggacttgcctgatcacttttgctagaaataaatgtccctccaaattaaattactaatgtcgcacatcagatcgtatttaaatccattagaagattttactgttccattagagctacccatagctggtgaagactctgcttatagtggaacctagtttctcagttttccatttatatttatttacctgagctttttgtaaagtagtaagtacttgactgaatttctgctatttatcaaatgctttttgaatagaaataatgagttaataacatttagccttttttggtaaatagtataaacaagatagggcaaatatgtaaactacttagaactttatctaccttgcatattttgtacctcttatttgcatatgcatgtcacatgctccttatgtaccatgtgctattactgtgccggggtactggggctatattgagtctatttcctgtctttgtagacttgatggataatttggacagcattgtgatattccaggtttaagagtcttaaggttcaagactacattaaatgttaatgtagtccaacatttcttgaactctgaaatcctctgagcatcttttcatgcactggcctaaaatgttttcatagcccagcaaaaggctgattacttatttccctcctattgattttttttgagatggggtcttgctgtgttgccctgtctgcttgtgaactcctgactccggtgatcctcctgccttggtctcctgtttatgttttaaatagcatttctcaaacctatttgagcaaataactttcctgttaatatgtagtattccttgaaagaattgaatttgtgagtccctaatctagacacttttaaagaagaaacaaaactcagtaacacatttggataaaaacctgaatatgtccattttgggatgaaaggaagcagctttgtttaccatgttgaattaagtggaaaacatcttattttaatcatgattgatagaaatctaaatttgtaaattctgatttttatgttttttttacaatgaaaatacattttaaatgtcaccatccccttccccatgaagtcttcattacaactaattttgaaaatactctctcatttatttatattatatatgcatatgttctactgtataattttaaatacttaaatggggttatctttttgcattgttctgtatcttttttcagcttaataatttaccttgcttataattattgtcagtgcttgcggacctgctctttatgcatttttaaccattgcataaagctggaatgatggacatgatttctttaatcactccaaattagtcatttagttgtttccagttttttagtattacaaataactctgcaataaacatgtcttgggtatgcattcttttagtttaaaatagtcttgttccttcagaaagttgctcaataatagacttagaaattcttttgtgctaattactgtaattgctcattttaagatctccttttattgttttcatagtatataatcctaaactgttacaactgaaatagtccttgagctaagaaagcaatgtggcttaaagataggatttctaaatagagacttaaaaattaacctttttggagctgtgacttcctgatgaagtggcagcacacaggctgaatatgttctacatctggatggcccaacatcatgatgctgtgatttgcgagaagctctctgcctgcctaggctgctggaggatggcaagttaatttatttgttgttgggagacctccccctgcccccattaaaaaaattattttgaaatacttgtagattcacatgcagtttcaagaaataataaagagtaattccatgcaccattttcctccaatagtaacattttgtgaaactagtacagtatcacagctaggatattgacgttaatatagtaaggatatatgtcatcaccacaaaggtacacctacttcccttctatctctcctctctccttcatgcctggttacaaactaacctgttctctctatataaaattttatcatttaataatgttctgtaaatagactcatagtatgtaaccttttggaactgaagtttttccatcagcataattccttatagattcattcaggttgctgtgtttatcaatagtttgtttctttttattgctgaatggtattctgtggtgtaaatgtactgcattccatgagcatggcatgtccctccatttatttagtttttctttgatttacttcattagcattttgtagtttttgtagtcctgtgtatgttttggtagagttacaccctaagtatttaatttctttgctcattgccagtatatagagatacaacttattgaactcactttttagtttatgctagtttattactaattatcaatacatgctcaagatatgtcaactccttttatttttattaggtgtcacttgctacattttgtggagaataccgatgctgttgctagaaagtgctgctgtcacaaagtgggtttatagatagtaccacgctatccttcttcctaggctagattagaagttatttatgtgctatatgcacatagagtttttgattggtctattgcaaatactatggcatctgaaattttttttttttttttttttttttttttgagatggagtctccctctgttgcccaggctagagtgcaatggcgcagtctcagctcactgcagcctctgcctcccgggttcaagcgattctcctgcctcagcctcccaagtagctgggattgcaggcacccgcaaccacacccgggtaatttttgtatttgtagtggagacagagtttcaccgtgttgaccaggctggtttcaaagtgctgggattacaggcgtgagccaccgtgcccggcccctgaatcctatttttaagtataaaaagtcttttttcagctctggattatggtgctgcaagctgatattcttctcatggcagtaaacagagaagtcctaggggtaatcttacccctctggggagtccaggatatctgagcatctcccttttctttttactgctagaaagaatttctgctagtagaatnnnnnnnnnnnnnnnnnnnnaccccccaccaccccaccaccgcagccatcattctgttttctgtctctgaatgcgactactccagggaacctcatctaaatgaaatcacatagagtatttgtccttttgtgactggctgatttcacctggcataatgtcctcaaggttccaaaatacacattttcctgctgagcaatttagtctaggttaagtcatacttgaccatatgccctagtttagcgtccagtttgtgaacattctttacctgagttattgtaattctaatctcttatgtaaaactgcaggtagtcagccctttgtctccttcagttctacatctgcggattccttcaactacagattaagaatatttggggggaaaaacagtaaaaaaaaattacaatacaacaataaagacaacaaatttaaaaactagtataacaactttttatacagcatttgtattgggtattgtaagctagagatggctgaaagtctatgagacgatgtgcatacgttatatgcaagcgctgccattttattgcagagacttgagcatccaaggattttgtatccgtgggagtcctggaaccaatcccccttggatactgagggatgactgtatttacaacatgtctagattttcgacaacttgaattaaaccagaaagaatatgaacacacagaagttcatgtgtatatatatatgtgtatgtgtttagaagggagcaagctgttaaacatgggaaatagttgctagtagtttgtaattttatgattacaattttaaaattcaattttgcaactggaatttgacttgattggttagtgccttacagtaattaacctccaaatcatcagaatgtcatcttgttatttaggtaattgaatctacttttcttgtatacagaatgctttttggaaacaatacactgtatatctagtttgtaccaagaactaattgtacacagtcagatacttgcagttcttttggacttgagtttctttatccttctatcagatgtcacaattccctcttccctttgtagcatatgaaagtagttgtgtgtgcactgtatttgagaatgtcaagtaatagaatctctagaaaacattcatgatttcagtcccaggtaatccagagttaaaaataatgttcataaggaagggtagcaaaatttagattttaatacttataggaggtgtgttaattggccccagggccgcaggctttagcgttcagaggactttagccccaaaggttttgtggaacttttccagagtcctcaccagtacattgggaataaatggaatgcctttggaagtactttgaagattgaattcgatagtgttggtaaagcagtctagcctgctgtgattgtgctattgatgcaaatattctctagcctgtattatttttccttggagctcaggaagtgatccccacccacctcaagcagtaaaggaaagagaggcaggagggtctgaccatgtgaggtgccccaataaagcatctgtattgtaaatcaggaatgtaggtattgggtttccttaaaacaaagcacacctacgtgaccactagctggagcacaatgtgggctcggtctgctgaaagagtcagttggttgcggctgtctaatccaattatggatggtcccagcgctcagcctttcagctgctgcccctcccctgcagactctgcctctctcaccctcccttttagggcttggtctgtggctaccccagaaatcacgtgcactcctaggcttcagcgagtacagccttgttaatctcagacatggaaagcaagttgcctaggtctacagatgagtattcagtttccccaccagttgacctcagtgcaggttttgttggttccagtcatttggggtcagcacctgtttgaagccaggacacttagaacaaggtggaggaaaacctgagggtacatacagtgtggtttccttggctcatctaatgcagagtcagaatgattagccacattgcaaattgtctttactcagtggtttaattgttaaccagggagttaattttttttttttattaaacaaagaagaaaacacctctagatttttctgggacagatggccccattgaaagaggccatgtgctgcagcgaatggccaggcctcgggtgtggcaagtgccttccagctcagtgcttgctttgtgctcctttgcctatttgaagacgtggatgaatcaaaatctataagcctatttcagtcaagtattctaaggaacctggaaacacaggggatttctctgttgcctctaatacagtgaaaaaccactgtctttttttgttgttgttgttgcattgggggaagaaagtccaggtttgcatgtacattttcactcataggatttttttttagaatagtttggggaggacattgtgctctggccaataactgggccagtgtctggtcacaagatgatcaggcaggtgcctgcatgactgtaggacagagaactgggcagctagagagcctgtgtggaacgtgaagcctttccccactttgttgccgtcctaaccttttctcaagtcatggagaattgatccttagacattccttacctctctcacccacttgaggattgctcagagcctgggtttcggattgaaatagcactatttctggttgatgacgacattctgtgagccagcaatgtagtttaaatatccacaagagcgccctggttccatcagcgccccttcgtaattggtcatgagacttggacctccttcggggctgggactcgggcaagggagttgagtagagcttctctttctgggctcctgggaaggattcatggcataaaagtgggacttcagcattctctgggcacacctgtctctgtttttgtcctctcctgaatctttctggcctgcagagcagaataaagtcactctgtgccaacctgacttttgttcatgactatattaggggcatggatagaaagtgcccccatagcactctcagataaaacaccttcaaacaaacccagaaacccatgctcacaaaaccacccaccttaaattatgaaactttcaggctgactaaatcctgaaggcgttggagcgtgagcaaagggaaaatggtgacacagagctttgcccttcctaatccaaatgaaaagctctgtaaccctccccccacctttgctatcaagaaatgttggacctttgggaagcagatgtagagtattgatccttaaaacagagacctctcaccctaggtctcttaaaacagagaccttaaaacagagtattgatccttaaaacagagacctctcaccctaggtctcttaaaacagagacctctcaccactttctaactgaagtgggttccacattggaagtactttgcagaaacttctattaccgcaattacttttgcaccaacaaatagtatcctcaactcagaaggaaagaattggaacactcagctggaggtgtctggtagggacatgtgtctgctttttgaatcagtcgtatatgtttttgttcctgtgcctggaggccctttgtggtgtgagaacattgaatttggagagggaaagggagacaaaagagaaatgggggtgatgcttaagggaaagtagggtttttagtttgttcaccacgcttgatggcagatttgcctctggatcctcaggccacgttcctatggtgggtagggatctctctctctctctctctctctctctgtgtgtgtgtgtgtgtgtgtgtgtgtgtgtgtgtaaatagtgatttctctaagttaataaagaatgtggggtgacctcctacacatgcccgtatgctattgtgtaggaacaaatgcatggtaggaatgggtagactctaatctgaaagcatcaagttgtatgcatcttctgcaattaggaatctgctcaccagcacgagtgctgtggtttctgtagttctgggattcagaggagcattttaaagatgtaggatgttggaggaggaggtgcagggatctccccttgggtaaagagtgggagacagtctctgagtcataatctgggaccagtggaaggtcaaagggaagaactgtcctgttgtctgctaagtcacaggcttccttcctgttctctgagccctgtcacttacccaaggtgcagcaacaattagtgtctgtttacacataacagacatctctttcataaaataatttttaaggcatttgtttggtagaagcttccctgtttgggggagtcttttccctgaatgcatgtaaataacttcacagtttgcgcaagtttgcaaacggtctatactgctcagccttgattgggctacccaaggatgcgcccgccctgctgaggtctgacagctctgggaggccagtgaggcctgtcctaatccctgttctggccggtgattcagctccaggtggaggctgtgcagaaacagccccggtcatctttgtgtgaaatacatttgtcgtcttcattttcttttttcttctgctggtatcttcatggttttcagcaaaactgtgtacattacatttttttctttaccatttctccgtagttatttctagcatttttttttcagctgatgaaagcaaatgaagaatttgtatgctccatagtcagtcaaacattgatttctctgacttttaacttagaaagtcattttgcagtggcttgcgtgtgtgtatttagactgtgcttctacaaaaaagcacacgtaggcttatggctcagtttacttgttccagctcactttcctgttcatttaccttcttgtaaaatggaaagacaaacataccttaaacttaactcagatcgtgattgccaactttgttctctgtgtgtaagtagttatattattcctaggttatggcatcttgatttatctttgaaagaagaaaaccctcactgagttgacagggacacattgttctaggcttctacaattgtgctgatgacgctttttcccattggaatgacagggatgataaggtcggctggctagcctttttttaaaatgtagaaaaccacaactttaatttatagcatcatcattttccttatgtatgtagtatgtttcaaaaataatccaatgtcagattcttgcttctgtgatcaaggtcttgtttttgccctttctttgctcaccacttccctgcccctgacgccgagtcctcgccttagaggaggtggtcagcttatattgcaacattgaaaatgttataccttacaaagaaggtgatatgccatttcttaattataatgatgtgcaacagtgacttctgatgtagacctttaacattgggccacgcagctttttctttggaggaggggcatttcaaattggatgatgctcttatagtttaataaagaaacaagcaaacaaaataggctatacagggcatgtgttcttaaactctgtgacagtggaggtgaacccaggcccctttcatggccttgggagggtcctcagctttgggggcgagttatctgggtggaaaagcaccatgggaggaagaagtcagagaggcgggttgctggagctcagagaataaaagcaagtctctgccctgaaaatggccctgatttgcttcagatgtactctgtctgccaacatttagtgtctgtgacttagccaaaggaaatgtacattaactgttcagtttctatgtagtttgtgctctaggattttgcctccggaggatttctgtgaaggaagctctgttcaagtggctctgttccacttgggtttggaaagaggccgggacaggtgatttcgaaggaaggatgaggacaatggaggagatgggcttggtcattgcagtgtgtgaggtggcccagcttatctggcattttggggtactatatgtgccatatgaggtgggtatgggtgtttgaagggaaagggggtggcctgggcaacttgtgtccttgcctagaaagatcatcactctttttatttaaaagaaacatgtgaaagagccatcagggatagttttgtcctccctcttcttacaagtgatcattcccttggtagggcagtgccagaccctgcttgtgagcacagaaaacgccataagctcctcatgaaagcatgtctggggaagcttatctcaaatgcagtttgcacttgcaaaggtcctgtggtatagcgggggagcaggggagatggagtctgggagcggtgaaggctgggtcactagctggctttgtagcctctgggcgtgttgtttttatcctcagaggggccactgcacctgctccatggtctcttcccacagcagacccttctgtctctgtgcctcgaggggctatgtggaaagcagagaaagactcaaccagagtcttcccttaaggaaatcggaaggaaaacaaaattaacggcattagaactgagtatgtattaaaacttctactgtcttacaaaatttagttttctttcttatttttctttccatgttgactcagtaggtaaatggactaaacacacattcatttagggcaggaagaacttcatcatttgattacctttagttcatttaccttataatgcctaaaacaaagcagaaagtgacgttggttaatcaaaaagatcactttcttttttgtgttcttttgtgctattgtgagatgcctcttctccagcaagctgtagttgttcacaaagtaaagctgttcctaagccttcattagattgaagcttgtcccagactttctttaaagaagtttgcatagcttagttcatgctcagatgattcagtgatgatgatgggttgttggttagaaattacttaaaaatgcctaatacattattgactgataaatgttaagacatattctttaagggtctaaatcctattcttgtggagctgcaaagatcttgggggtgtggttgcccttgtctgttgcatcatctttcaaatgcaacagctgtaatgatattctgtatcttgaaaaacttaaaaaagcaacaactaacttatttgtatcttttcctctaatatttagtttttacttcacttgtaacttattacatgtattaaggagtttatttttttatgacattttactcataaaaggatgaaaccaagattggtgatctgttcacatagattaaaatcctgtttgtgaccacttaggtgtgtaatgtgtgacttgtggactgtgtcagaggaagattttccaaccaaaagtacccattggtatcacagatgaaaagtccttataccatctgaaaaaaagtagaaggtggggagaagcttgaaaacctaaggaggccattaggaaaggctgtatattttctgattccgtttaaaattttaagttggtgaaaatactatgtgatcgaaggatgaacatattttagtaaatagagttatagtgctacaatgagataaatttcacaggtaaatgtgacgtagctaatgcataatcattctttgtgttgcatggcaattctgtacaaatagaaggtagcatgtttaacgttcctgttatttcacataaatacagactgagagtttcagtggtctggtttgaaagggaagaaatagaagaaggaaggagagaagttggcagaggagcaatctgctctaatatcctccagtacacaatctagctataggtcctcacctggcagggtttgaggatcagaatggtggctcaggtttagacaattctccctgtttgtggggcccagcagctagttaagagaaaaatcttttttccttccctattaccctataaggtccccaaattcattgtatgtagaatacttgagtcagaataactttcctaacacttaagtttcaggtttgttaggtatgcctgacagctctcttatcaactcccatttatttgctaatctaaatgaaagtttgatggtagagtattgtaaatgtagggaaggtgaagtgttcaccttccagatggtagctatttatctcagcaagaagagcagatgactaacacccaaatacataaccattattatatgacttagcatttataaggcatttctatgcatcctgagagactagagcactctcaaatgaggtttcagagtaagattcatctttgcaaatgaagacaaattagcaaaatcttcctatttttaaagtgtgccttttgatttgatacctatttatttgtttggaaagaagcttttaaaatcaaaaccatgaatctgtggttatcttcaaaggataaattatgataggtagttgttacccaggttaccattttaagatgattatggctggcccaaattaggggatcttttcatatatgtattatatattttaacttcagtcttttaaaaatgaatattcctaggtggcatgggagggtgggaaggtcaaaagcccaaacttctcttacttattggctgcttccttgaacttagcgtttttcttttggaaaagtgagcttttgtttttggatattttgtactgatactctgtgcctacacagattttgttttggttcaataagagttgatattttgccaggggttgcctcccatgagattccaaatacagatgtaagtttaacaggcttctgaactggatgtttctatgcgctgaaactctgtaaacgcgtgtagctttgtctaccattgtatattgctgtattgatttgttgggttgttttttttcttcctcctgaaaagctctggtctgtcctctgctgatacaaagactggtccattccccagggtcactgcaagagaacctccagggcctggccactgttagatattactaatctgtgaagttgctccaaattctcttgccccgatcataaagttccattgagttcaattttatgtgaaggttctttgtcaaaaggaataaatgtttattcaacagatccagttgttgtcagcattgacagatgtgaaaattagcaaatagcaagaagtctcccctttagaaaaggaaaacaagtacttaaaaaaaatcttgtgttgtcaataaacaagtccattttaaaagcatctttgaaggtgtgtaatgaaaatggaggccttaggttgtatcagggtttatgaggagccagcttatctgtaatcagatgttcctgttactgttatcactgtagtatagggcttagttctgccctttaagtcacagactcaagttactcctgattttaccagcagtcagaatacatttttctttaaaaggaaaagagacgatatcctagtgcttctctatactaaaacaggaagagaagcttccttgttgaagtgacagtttagatgttgttattttgacagaaatattagtaaatatgtcacattatcccttgctaaatatttatagcatagaacgtatactctgatgcataatattttatgaaagaaatatcttttgcctcaaatccctttcactgttttgacatgaatctataatttatacccagaggtctgcaggaaaaagactttattaagacccttttatttcagccaagataaaactccatcctaagagggaacaccctggaatctttgagacccttaaaggtggggtattctgaaatacctgtgttcgttcctttgctagaatttagatagcttcacttttgcaaaaaggcacaaaatgagggcaatttttgatggaaaattttagtttttgagatgaagcagggggcacagtggcgaagcgccctatcttagcacttaggtagcagccgtaacaagtgtcctgggtattcctccctagaaaggaaatgttggtcacaaatggcagtgtcctctgcattcagttcagctatgtgactgaaagacactgttcttcagcagctgtgagtttacaagatgtcgcacattgagtatttttctctagcttatttagaaacgccagtctagacttccgcagttttggattcgtggccatagttttggcctttattagatggccctcaaaggtacttttcaggtggacattgatttcatgccagctgtcagagatgattttccctagaaatggctgggtatatggagacattctgtattagaatggaggtatacacccatctcttctgtattagagagcaggtgttgccccccgtggtgctcagattgcttagtgtgagaaggaaaagaccagtgataagaggaggaaaactgcgccttccatgtagctcagttaacagcatcatgattctccaggatggccccatttctgtttttatttacaaaatggacttgagaattaattagtaagcaaactgtctccattaggtaagtggcattctgatttgtctgtgtaaagttccatttcccaagtaatgtgttccaaagcatttttatgtacaactactggaaactgctgtacaaatgtttgctgctatttggttgtaacaaaatcagtaatgagtttcaaaatggaataatttcagagcccttcatctacagtagtttgggaaacacttgaaataccaagtgatctgaattcactacaagctctccaactggaaaatgtgcctggtgtcgtcttcaagcaagaatcccccgccccttaaccactgctgctgtggacttgagtcttcaaccttgttttgtagactttagcatttgtattgtgtcatccttgacacctccccaaccccagccttcccagctttgattgcttaccttagcaatgctctcagcttggaccagaaggcacggatgtttccctgaccttaacctcactgtgtatcagctcaaggaagaagccagatttgctgatgttgtaagcactaaattatgttcataacatttaaccctcacatccataagcaaactaagtgggaaaataaagattgactattgtagcagtcatagattgtttaggaagcagcaaaaaggcaaatttttctttaaagttcaaaatggggcgaaagagggtaggaaaggaaaagtttattaagaaaattgtatactacattaatttgactttgccgtctagacttaaattaaattcatgtatttttttggtcttaacacattgacatgtatcagtaagttaaaaacttaaaaatacacaaatgattagattagcattattatgtgtttctttcttgttttttgttttgttttgttttgttttgttttgagatggagtctcactctgttgcccaggctggagtgcagtggcatgatctcggctcactgcaagctccgcctcctgggttcatgccattctcctgcctcagcctcccgagcagctgggactgcaggcacccgcaaccacccctggctaattttttttgtatttttagtagagacagggtttcactgtgttagccaggatggtcttgatctcctgacctcgtgatccacctgtctcggcctcccaacgtgctgggattacagtcatgagccactgcgcctattatgtgtttcttatagaaaatctctctaattttttaataagcatgtttttacaaatgctgtttcctgagaactgtcgcaccacatgcgacatgccatgcatgcgactggaacatgccagatatttgtgggtggtcccttcgtgtcacctgtgccttcttaccaagtaatttgaaacacccgtgtaaactacctttggcaaataggatagctaaatcaccgctaagatttataatttactttttggatatctgaaacatcaacaatatagccatccatggcgtgttcctctggagtgtggtccgtgccgtctctgcctgctccatctggctgatcccaggcaggcagctcagctctcagcagacacagatccccagcacatatgaacgtgaaagaggcttctccgtgggagcgaagtggccagcaggtgtcacaggctgtgtgggcccagcatcgtgtgggcactgctgggggaatcccatcacagcatgtgctggcgttagtagtagactgtgtgtgtctcagagggtccagaaagtaatacagtaaaggcgcctgggggtgtgtgggggtggttggttggggtttgcttgttagtttgttgtaaaagcccagcttttcattcttggaaagatttcagccaactcgagagggttacctgccaggaatgctgcagaagcaagaactcagtgggtgagcacttccatttcttcaacaaatgcttctgagtccctgacctgtgccaggtgctcttcttgagctgagaatcctgcagggaaaaaagagataaagaccccatagtcctgtggtttaccttctaatgagcatacttttgtcgatcaaacagggtgacctctctggtgtctctgcacactacctgtatggtctttccgtagctgatggggtctcctgactagtgattggtgattttaatctggattttgccacagcacttattttctaacatatgacttaatttacttaataattgtgtctattgaatgtattcttatacatacacacaggcatgcacacacggacacgaatataagctttacaaggacagaaaccttatcttttatttatttcttccttgtgtatcctgagcactgagaacagcctggcacaaagcagggctcaggaaatgtttgctgaatgcatgttcacactggatgtgttcgaaggctctcactcgcgactcctgttggcttgtggagagtgcatctagctgtaaaagccatggtgcttggatgtcttggggtgctgagcctgttcccccctcatttgggggtgtggtgctatgctggcgtttgggtccatgccccgcatttctgatggctgccccatctgccctgtgtggggtggcagagttctgtgtacacagagttacatttcgttgttcctggcttctctatggatgacagcagcactgataaatgccacacctgctttctcagcagtcttgcggggtgatttttcctcttaaggaagtcacctgatgtccatgctgagtaggaaatgcatccaaagctttgggagctcagtgttggcccctgggctgcagcccgagccccgttttagagctgtgtctcccaggcagctgtgatgactgctcgaaagcccactcagggggaaggtaaacctgatgcccgggtgtttggacagtgagcatggcgagtggaccgttacctgtgcatagagttgttcatatgtggtgacagatgttgggctgttatttagtaacttcaaattgtttttctttgcgtcggagccatgtctaggttctgagtgcttctcccaggtcagatggagagctcttcatttggggttgggggagcggggtggtgttttcaggtgcccaaggcattccatgcacatgcacctgcagggtatgtgtcatctggggtaagacagagccctcccggttcctcttctggatgtgtgcttttagtttttaaagaatgtcagtatatacattgccatttattcaacaaatacggactgagcattctgttgtgctgacgtagctacttggggttacagagacaaagccaactccattctccaaatggaaaacaaatggaaacattctagtggtagaaacagacaacaaacaagtagacagaaaataatgtcagacagtggtaagtgctatgaaaaaaatacagactcactgattgtgatggagacttttaagttggattctcatagaaggcctttctgaagaggggacatttgccctgccactgtgaatcagccatgagaagacgtggagaggaacatgaggtggtaggccccagcgagggaaagatctccatgatggcatcgattattcgctccacaaatattattgagcacctgctgtgtgccaggcactgttcctggtgtcagggttatagaagtggacaaaatgaggcctctgcctctgtggagcttttattaaagtagggaaggggatgggagggctgggtcacatgttaggtgtggggtacagggtacgtggtgccaggcaggtatccgggtacctttttacgtagggtattcagagaaggtctctagagaggtgacatttggacgaagacctaaaggaaagggaggggaaaggcgaggagcttggagagcttggtgcatcttggtgggggatggggtaaactgagtcagttatgtagggccctggaggccacggtgaggacttcggctttgactctgaaaggagatggcagagtttggagctggtgtgtacgttaacaggaccatgctggcagctgcgttaagagagactgtaagggcaaggacagaagtagagagaccagtaggagtaggctgttgccccagtgtagggcagagaagatgaaccttagaccaggatggtggagatggtcagtggagagaagtagtcagagtctggaagcaccagcaagactgtctggtgcacacaggatgcacgtgggatgtccagtgaggaggatgagatgaggttgggtggctggagcctggtgagtgacaggcagagagggctattagatcacatgggccctggagccatggtgaagaatttggattttgttctctgtgttggaaagttagcagagagcttatatggggggtgagatggcatagggacaatgttaataacagcaacgaatatttattgagcacttactgtgtaccagctgttgcaacagcctctcaagggttcgttctgctattagagccatgttataaatgaagaaactgaggcacagagaggttagctaacttgtccaagatcacacagttagggacaaacttgacagaattatgtgtgtcctggtatgtatttcagttttctttagggaaggtaccacaactttgggtaactatgcccctaccccaggatttaagatgttttgatggttgaagggcgatgtttaagagtgggaccagagaatattgaggtattaaaatctcactaaatctgtattcattatatctgtattcatggtataattcatgtgcctccccctttcgtgagcccctcaaacatgatcatggatatgttttctccacccgtaaagtacgttcatattcatagaaaacccacagagaactgcagacctgaaggtttctttgtaagagctttcattggatagctagaagggctgcagtaagtttaaaaaaaaaaaacccaaaccaccctggattccaggctgcacagcctctaggaggtgtgggtaatccctttataaagcttggcataatttctgttaagacttgcttattttgctctcagcttgctatcttgatatgtttgcctttgaggaggttagagttattgtgatttaatcacagaccatgtatttcgcaagattcatttggtatctccagcttgttttcttgtttcctcggctgtcagtccacaggcagaggtgggaggcggccggcatgggggaccgagtgtggtagaaaggagtgtttacttagcggaggggagtgctgagggctgctgttaccttcccagaatggctgatccccagcagtgatgagcaggctgggatcgtggtgttaaatttggtattttctagaaatatatagcaggctttcccctccacctgccccccttcaaggtttcgaagccttgtgttttgcaagagttgagaggggaacagttaatagcttggattatcttgtctctggagagaatttatgtatcaattcaccggaagactgctctggtattagggcaacaagaatggttttatttctcccttcctttcctgcactctgttcttatgtaattcttgtattaaaaccattcctggtaaattagaacatgctcttgtatttgggccctgctttgaagaaggctgctgagtctaaaaagtttggtagcctctcgtttctcatggtgatttctgagatttctagggacttggtgttttacagagcttgttgagttgcacaaaccagcctccttggcccttctaggtgataaaagatgctgggctgggagggcagctgtggaaaagggtgtgggcgagggagacagtgcttcatcctgcctggatgaagcatgttggttgttggtttattcataaattagaaaaatatattaagaattgaagttgttccttatctcataagatttctagcaggctgcataaagtctgtagatggtaatatccatttaaaagtggacaatgaaaaaattacctctttgggagttgtgttgctatctctaccccaatttggcaatctttaattaacttggcaacccccgttttaccaacaaagaacaacctttgattaaaaaaaaataaaatgtcagggagtgaaagatacggagtgtgactcagcagatgggaattcctttaataacacgctgggtgttagcgttagaaccgccactgaacagctctgcaggatgccctcccagccctccctccgcctatttggattagaccaggagactgcagcaaacttctcaaggggaggcgaacttggtgttggtatctgagcgattgtctgtttcaattgtttccctctgtcttggaaaacaccggcacaaaacacaaatccagtcccagttcctgcagctgctggggcgaagcaggctttttatgaatgaggcccagaagggggaggagagggcttgtgttacagcagcagttgggtaatacatttcattcacttgcagccatctagcccaggcttcattttaaaggatattgttcatttttggcaattcagattagactttttttcttccttgtgcaactgttggtaagttagaacacgaagcatgtgtgtgcattctttttgcttgcttttttgagtgtttgctcctttagttgggataaatggtaggagaggtaggaaggctttgtcatccccggggaccttgcttacttctccctcccagcaccacttaagagaagaggaggtggcctccctctccccaacctcagagccctcaaagcccttgatagtgagcctgagcacttgttaggaggtgacttctacctggggtgtgctggggtccacatgtgccagtctctctgccctgctccccgtgagcggctctttatttgtggcccttgaggccccattgttgtggccaccaaaacctgaattggaagctgtgtgacaatgctggtccccctccctgcactgcttcctgctgggggcagaacaaagagagcgggcattgtctctggcataaatgaacctctatcaaaacaaacacccagagagaggggcagcctggttacagctgcctgtgtgagcctcgacagtgggcctcattcctcacaaagggagctttgaggcccggaagaggcctttccttgatgatcgagctgtgcacagggagcaaaccccaagccgactgcttgtctgtgccaccctcaaacaatgatttccccaaattggacagcctgggtttgtatccttgagcacggttttgggaagagcattctgcatgaggcattgtagctatgtgtatggagtataattctgttttcaggttgctctgccacagaggttaagaactccctcttccaaggtagacattgagaacagagacgaccacactgggttttcactgcagcttttaaacaggatgactcccagcccccatccccgtggctagcagcaagcagggactctgaaacactgcaagccaatggactgagcatcttacttttgctgtccgtgttttggtgttttgtaaacccatctggtaatgaccctgatgccccatgtcccagcaagggcataggtacctgccattgtgcaccaaagtccctttcctcatggccctggctgttctcctgcatggggtcatgtgtgtcccgttaccaagttgtggccccttttcaaccttgagtgccacatctgggctgttgtaggcatgggtagtacaagctgggtttgttactctaaaaatgaaagggaggatcagttgttaataccttcctgtaggtgcgagagggaatgagttgaggattcgatcactgtttatagccagtctcggatcctgattgtgaagtcattctttctggataataactactatatccagcatcttgagagtataaaataaaggcacatgttgtacgtcatctctgagatgtagcgatggcttggactttggaggctgatgagagaaaactcatggtggtgagctggagcagggtgtggctggcggattctgaaggtgctagccctagttttacagctgaccagggaaggtcattgaaccctacagtcttggccctgagagaaccttggaggacttaaggatggagaaaggtgacaaaagagatgcaagccaacagcaattttgtggaacaaagtgtgtacaggatttgaacttaactctgcgaaagacaggggttgcttgtatgcacgaattcacatctgaagaatgcatctgattgtggctgcaatttctgtggacgtgcaaacatctacctgtgcattttatttgtctagcatcattgaaagagttttttgcttgagttgatttcccaggtaattgaagcttacttctcaaagcacaagatattttttctcatatattagcggtcttaagtgagtgagacccctaagaattcttaattcctttatcttacttttcctacaggaaacttattatgttttcctagataggaattgtgctaccaaaaatgaaaagtaaacgtaatatgtaatgttctactggtaattgtttccattttaggttgacaccgaactaatgatatttaaattgtagctgacttgaaacacagtgaaaaaatggtttcctgctgtttttttaaagctggattcagtaacatgaaggtaattaaaaatgtacagatctcagtaatagacagtcatatgttgcttaatgacagggatatgttctgagaaatgcattgttaggtaattggattttatcattatgccagcatcatacagcgtactttcacaaacttagttgatacagcctactacacacctagggtccatggtatagcctgttgctcgtaggctgcaaacccgtggagcatgttgctgttctgaacgctgtaggcaatggtaacacagtggtaagtatttctgaatctaagcatagataaggtgcagtaaaaaatatagtgtaaaagataaaaaaatggtacacctgtatagggcacttactaggagtcaggcttgcaggaccagaagttgctctgggtgagtcagtgagtcagtggtgagtaattgtgaaggcctggataaatactgtacacttaggctacacttagtgaatattacattttatttatttatttatttatttatttatttatttatttatttatgagatagggtcttgctctgtcccccaggctggagtgcagtggtgcaatcacagctcactgcagcctcgaccgccaaggctcaagcgatcctcttacctcagcctcctgagtagccgggactagacgcacacaccaccatgcctgactaatttttgtgtttgtagtagggatgaggtttcaccatgttgcccaggctgatctcaaactcctgaccttaagtgatccacccgcctcggcctcccaaagcactgggattacaggcatgagccacggcgcctggccacagttaacttttttaataagtagaaggtgtacactcttaaataactataaaaagtatagtaaatacataaaccaataacatagtcacttattatcattatcacatattatgtactgtgcactgttgtacgtgctgtacttttatacagctggcagcacgggtttgtttgcaccagcatccccacaaacatatgaggaacatgtacatcttaccacggttgcaatgtcactaggcaataggaattttctagctatattctatccttacaggaccactatcgtatatgcacttcatctttgaaacgctgttagctgcctcatgactgtatttctattcctcagtcatgggctcaccatgcagtacacatgtgtggtcactggagggaatggaagaacactgaggaaatgcatagcctgtttcatatatttattacactattatttatttagaggaatgttaagaaatcttgcttttatgtagttttagaatgccatgaaatatctagttggggcattatctgccattttgcaaggtaatcttccacttctgaataacgttacaagtaacccgcgtttggaggactgatttgggactaaggcaaggaatttaggaggcacaagtagaggggaagaaataaacacatgacttttgtttttgtttttgtttttgttttttgaaagaaggacagtggtttgcttgttgattctgctttgagaggatggggatgcactccagagaaagtgaaacggggctatgggaggaagagagcagcgcacacacagcacctgcatttgattgtgaatgcgattgtgactccttaggcaggaaggagagtgctaagaccgtcatcatggacactcagaaaatacctgctaatccgtttactggaagatacagggagctgcagataattattgttttttaagatggagtttcgctggagtgcaattgtgcaatctcggctcactgcaacctccacatccccagttcaagcaattctgcctcagcctcccgagtagctggaactgcaggcgtgcaccaccacgcctggctaattttttgaatttttagtagagacagggtttcaccatgttggccaggctggtcttgaactcctgacctcaggtgatcctcctgccttggcctcccaaagtgctgggattacaggcatgagccgccactcccggccgctgcagagaatttttaaaataaatgatagattctcacagataagaagaacaggataattatttgccaaagtttgaaactgccattatattcaaaggcattctcttttgggagtggttttatatttaaggtttgaatttagatgacctcaatcttgaggtgttatcggagcattacaggggagtcttatatacatgcaggtgcgatttaatttgaagatacttccatttaaactttatgctgccagagttggccagctaagcaaaaagaattctgataggtcttattctcctccccatcccacacgctgattttttttttctttgtgtttggccgaaacattttacatttctcatttttcacagagctactgtttctctaggattgttttccctgaagtgtgtaccctgtgtttgggcagagcagcaagaccagacttccaaatggcatgctgcgttttaatgtgctttcataattgtctgttccaaaagggtgcctgtgtgtgtatggtgtgtgtgtgtgtgtgtgattcagagcacctgagagcacactgcccgttgtcccctccagcccttctgaaatgcaggccaccctttctgtttcagttgccccttgggtggcagtctgtgataactcaaggtcaggaggaagtatttgttttggttgtcttgtttaactaattaaatctttaatcttggtccttaaaagaaactaaaataaaatcgtaaagtagttctgataagtccttgccataaattattgcttttgtaaacgcacataaaggactctgaactgttgctactcataacatttctgacgccaaatgtgtggggttttgccataccaacaaccagttctctaactctccagacaccaactgggggccttacaattcagtgcagttctgacactcaccacctggagttagcacagactccacagggatgagggttcagtcccacgagtctgcccttgctgcagatgcgagtagcaggtatggggtgcccacacttctgtctgacttgcctgaaaggttgagagtttgttgccaggccccttgctttcaggtctgataacttgctaggttattaaacctgaaacttgataacttctgtagatgttgaaattagaacggcctcactcacctgggctcacaaaattccagaaagtagttgacgtcctattactggtttaccgtgaaggctctatgtccagagtggacaggacaagtggaagagtggcacagggcgaggtgtggggggtggcgtggagctccttttcaggagtctctaagaaggtgggactccagcggcaatgccttgtccatgtgctaagccagccgagggcgcacgaagtgctgtgtggtgtccaagctgacttgggagggaccagtttggggccagccccccagcctcacttgtcatgtcccacctctgctggcatctgtgggcttaaagtgccttcactcccatccttttcaactatttcttgattaaaaaaaaaaaacaaaaaactgttgaatagtaggagactctctctctcattggtatttgtgggaataaatattaaataaacactttctaataggtgttaccaggacgcctaaggaaattatctcacagagttttcaacactgtgaaaagagaagctgactgccagggagagatccctttttcctagtccttgtgaacatgtgctggacagccaggagtggcactgtggcaagaaacacccgttctctggcattagtaagagggatatagccaagggtatctgtataccagtgttaggcccatacatccataaaacattgatgtgagagctttagggcacagctgaccctaagcctaacgtgatcattaatgtcatgaaaattggagaattggtcaggcgcggtggctcacacctgtaatcccagcacgttgggaggccgaggtggatagatcacttgaggtcaggagttcaagaccaacctgggcaacatggtgaaaccccgtctcaaaagaaaaaaaagaaaagaaaattggagaatttataacgtctgatgtgacctgttctttaggtgttgaaattagaacggcctcactcacctgggacattcttcagctcatgccctgtacctggcttacagttgctcagtgaaatgctttcttgattgtagcatggtgggatttttataaatccaaatgacttagaggtaggtgtcacatttttagcagctaaaatcatactaatcgtaaagctcagattcctgtaagtagggcgctgagcacaggctgcatcctggatatatgaatagatgaaccagatcgtgtacatgtgggacacgttctttgtcctttgggactttcttttgcttggatgttggtagtaaccatgtaagttcgggcagctttctagaaactttccttgttgtgcaacattatgcaataaatgcactgctttgtgatatctgagacgttttggttttcttcagcttgtttgagttaaatttagactcctggcatagttttaggtttgaatgcattctctgagataggataaggaccaaaacatccactcagcagccagatgggattttatccttgtgctgccatttttgagactcatgcctctgtttcactctctgtaagatggcattaatagtgagggattgttgtgctgtgaggtttaaatgagctaatccctgtgaggagtttacagcagggcctgggccatagtgaaacactgtgtatgtggaagccacttcacttttgtcatagctttgttgtcattagtgtataccctgtctccttgccgtttatgggtccttctttcaagcagtcggattttctgtctgacatagtataagtttagaggaaacaatagcagctgtaagataatagtaattttccttctgaaatcattttggtgaatttagtcagaatatctgatccataaactctcattataaaacattgccttatgattggagttttttctgagaacagttccaatgaacatgattttttggtggtgaggtactatttctgtgcagtaatgaagttgtgaggacacacagataccacatccatgttgtttgggaattgtttgggaaaggtacgtgggatagcctggcatggggaagaatgatgttagggtattctccttgaggagctcagaataaccaaaggtaaagcatttggtggtataagatatattcatcttaaaaataagttgaaaataataagatattgggagatgttagccaccgaagtaaataactacagtgaaatagctctttattaattttgaaacctaaagttgaaagagttccgtattatttgtcagtatctttatcctcttcaaaaatgtttccagctttgggataaattgtgaataattgtttcactttgttttttaatattggctatgtagtgattttgcattgaactgtgatataagaatgatcatcagccccttgagattactgtgtgtacctgtgtcaccagtggcatataggggcttaaaagcaagcaagtttaatatatacattcattgagaacacactgtagactgttaggattttcggtgctggagccatagtgatgaatatgacaaggccctcacccttgaggtgcctatagtcgtgtggaacctaggtcctcgcagggactctagggcaggtatgttcttgaaagatttttttttttttttttctttttgaagagacagggtcttgccttattgcctacactggagtgcagtggtgcggtcatagcccactgcaagctcaaagtcctgggctcaagaaatcgtcctgtctcagcctcccgagtagctaggactacaggtgtgcaccaccatgtctggctaatttttatttgtattttatttttatagagacagagtcttactctattgcccaggctgatcttgaactcctatctcaagtgatcctcctgcctcagcctcccaaagtgctgggattacaggcatgagccactgtgccctatgtaaaagattcttatcaacagttaaaataagaagctgctcaagacatttacctatcctgaatgtttcaggccctcaaggtgccaggtagctgcaatatagttctagtgtagaaaagaaaaccctgatgaggtctatatattccaggactctgtctgaggccctttgacactccgggggcaccctgccgtgaccctgactctttcctgcatgtactgaggatggaggtagcctatgggtggcacagagatttgctgtctggctagcagtacttcagggtactgggtggcttgaggacctcctgttagaagcttggattcacttttcccaaggcaaccaggattggattctattagttctgggtcttgagagcctgcaagggcttccttctgcgaaggtgagtctgggagagacgccatggagtcagtgtgagttctgcagcctcccaagttccgctggcgtgagaggcttgcctggtgccagggctctgggcattgggaacattgcctggtctaccgggcaagaaacgtgaaccaccgcagtgaactggcagcgcgttggcatttttccctccatgtttttataaaaccgctgagtagacaccagattataaatcctgtgtaaatagtcttgaagagtttctgggttcagccccagagaagactggtttgggttttgaggaatacttcaagaaaatgtttgttggttctgttttccaacgtaaagtgctgcacaaggactgtgctgtgagatccaggagtgtcttttcagccctcagtgagtgcctgcaggggacacagctgctttggaggaatgtggttccggagggtttcccactctccatcctagttgctaaagtcacgttccacgtattgtgttctgatgatagaatgaaagcccactccccgcaccctggggtctaggtggggaaaggagaggtgtatatgggatagccacggggtttggcatgagctcagtagagacagcaaactgacccagacagactcccgctttagggaagctgggatgaactaagtgaaggtgggtcatgggagcaatgctgaaccactttggtggttacagtgaaggctgctacacacccagctttgggaggtggggcccagggtgtccagctttgtagaaaggcatggtgtgggggtggctggcggagggggtggtgggtggttttcctcttgaatctctgagaaccttgactggtgtactgctctctgctttcctaaggggtccgtagctgtgctggtggtttgcttggtatctgtattacatccactctgtgcttcagcctgtttgtccagttactgtgtctagtgaagctagcattcacatattttagattaaattccacactccacccccaaattaaaaccctgctatttaaggtaaaaataattttaaaatgttttattttggtctctttggataaattaatcttgaggaaagcaatacttactgaatgttgatgtgtgtatatgtctttctctttgtaccatacttaacaggcaagtaactctcttgtaaaatcagattctaaatgattttcttttcttttcttttttttttttttttgagacggagtctctgtagcccaggctggagtgcggtggcgcgatctctgctcactgcaggctccgcctcccggcttcacgccattcttctgcctcaacctcccaagtagctgggactacaggcgcccgccaccacgcccggcttatttttcgtatttttagtagagacggggtttcaccgtgttagccaggatggtcttgatctcctgacctcgtgatccgcccgcctcggcctcccaaagggctgggattacaggcgtgagccaccacgcccagcctctaaatgattttcttaagtgtaattcaggagttggcaaactacagcccatgctgccacatctggcctgccacacctgttgttgcacataaagtttcattgagtcacagtcatactcatttgctttcatattgtctgtagacaacctagaatgttagaaaattctttctctggctggacgcggtggctcacgcctgtaatcccagcactttgagaggctgaggcggccggatcacctgaggtcaggagttcgaaaccagcctgaccaacatgggagaaaccccatctctactaaaaatacaaaaattaaccagatgtggtggcacatgcctataataccagctactcgagaggctgaggcaggagaatcacttgaacccaggagttggaggttgcggtgagccatggctcatgcatgtaatccttgcactttgggaggctgagacgggcggatcacaaggtcaggagatcgagaccatcctggctaacacggtgaaaccccgtctccactaaaaatacaaaaaaaaaaaaaaaattagccaggcgtggttgcgggcgcctgtagtcccagctgctcgggaggctgaggcaggagaatggcttgaacccaggaggcagagcttgcagtgagccgagatcacgccactgcactccagcctgggtgacagagcgaaactccatctcaaaaaaaaaaaaaaagttatttctctatgtaaacaaagaaaactctccttccttataacttgtatgtgttgggtctatttgtattctgtgaaccataagaaataagtcaactatcagctgggcgtggtggctgacgcctgtaatcccagcactttgggaggccgaggcgggcggatcacgaggtcaggagatccagaccatcctggctaacacggtgaaaccccgtgtccactaaaaatacagaaaattctctgggcgtgttggcgggcgcctgtagtcccagctactccggaggctgaggcaggagaatggcatgagcccgggaggcggagcttgcagtgagagatcgcgccactgcagtccagcctgggtgacagagccagactctgtctcaaaaaaaataagtcaactatctcaaggtaattacccttttgaatacttgaggacatcttttctgtgccctctgaatatttccttccccagataaaatatttctagttcttttacttgttctttgtttcagagttttaagtctccatttgataaagtatagtttaatagccttcgaaaccacatcgttgagatttaaaaagccctccttgagagacatgaccagtagaaatcataccaggaccgtttagcaccctaactctgggagccatggctcttgggatgcggctgaagattgtgttatcgtcctgaagctctcttggacagctgagtcaatgactggaggtaggaaagttccttgaactctttcttgtgcccttccagctgtgagctgtgtcaccattgtattatttttacattgttgttgttcttgaaaaagcttttttttttttttcaaggcagagtcttactctgtcgcccaggctagagtacaatggtgcgatctcagttcactgcaatctccgcctcctggtttcaagcatttgtcctgtctcagcctccccagtagctgggattacagacgcctgccaccatgcccggctaatttttttaatttttagtagagatggggttttgccatattggccaggctggtctcaaactgctgacctcaggtgatcctcccacctcagcctcccaaagtgctgggattacaggcgtgaaccaccgtgcccggccaaaaaagcttttgaaaacttcgtcgtataatattatggccatccttccaaacgtgacctttttatgttgtattttatctaactaatttgcccttgcccccaacttttatcttggaatttcttacgtattaatatactgtcagggtccctgcttggggcattgtccttgggcttgtcattagataactccaagttggcttgactccagaggagctgccttcacacgtgctgtgaaatgtactgttgttgaccagagaccatcgttatcattaagtccacaaacctgcttcctgtctcttaggctgttccagtcttctatcgaaaaacagtggtttaagtggcttctccgatagtgctggtgaattggaagcttctcgtcatcccccttggctggggcgaggcttacttcctggggccttggcagttttgatctaactgacttatgttacctttctgtattaatcaagcctttttattttccatacttctgatgctttgacatcttggggccttgctgaccctgaagagaccagcccccctagggttagccagttcctaggtagtgaatgagtacaatgctcatatgcaaaataaccaatccaaaggccacgcccctcactcatatgcaaaataaccaatccaaaggccaggccccttaccacctttattgggatttcatactccaggccaatattgccctaccttaatcaccctagggccagataccaggcaagagacagcccctacaccccagagcctgtcagaattactccagccagctagtcctaaacctgcttaccttgtgtgatttattccttcccaaggaaaccacaataaaggctctcctccatgttttcctaccattccctctgcctcaggaccaaccttggttcttctccgtgtggccccttggcatggtgcactacctcttcttggggactgtgagtaacagactttttcagtggcaattgtcttttaactgttggcctcaccgtacctgaatagcagtaaaccctacatcttaaaatactttgagattgtcacatacagtacccagaataggtgaggatgaaggcaatttactggatgcagagcggccccagtccattccttatgtccgaatgctaagacttgagaaaggtggagaggagcctgactatcaagagttgccttcttggatgaagtgggctgaagacacacgaaccccttccattaatacatctacatattttccaccattgtaattgtattaataattggagaaaataacaatgactgtcaacaacaatagcttaatccagtagagatgaggtccggaataggttctggcctacctcagttcatgttttttactttcaatgctgaagcacaagcaaatgcaaaagcttctcttgaatgttttgtaaattgtgggataattgaggtatgtgacatggttaataacccagtgtctgctcattgagcactgggttattaaccatacatagcaaatggagcacatcatcgtgggttgcttgcgtcactagatcctgttgcaaaaccaagattcaactttaaaatacattttaatttaagttactctttctggcatgaatgatacatcactttggagcaacacttaccaggcagtgaaagctttttttaatgccctgtgtagcactgctttcggtgcccttatatgatttggatggatggatggatggatggatatagccacagggtcttgctctgttgcccaggctggagtgcagtggcaccatcatagctcactgcaacctcaaactcctgggcttaagcgatcctcaacctcctgagtagctgggactactacaggtatgtgccactatgcccagctaatttttaaattttttgtagagatgggggtctcaccgtgttgccggggttagtctcagacttctggcctcaagtgatcctcccaccttggccttccaaagtgctgggattacacgtgtgagccactgtgcccagcctgtttatatggttttaaaaacaaaaatgtatatgctctcaagatggctttcagagagcttattagtgtcttggccatttggaattccatttcacttaaattagaagagtgaaagagaaatgaatggaagaccaaaaatggggagaagaaattgtatctgatataagcgtggctctacctgggagaatggccattccgaattactggaaacaggaagaagacttgctatgatgcttccttatatctgtgggggaaaatcaaacttacattctgaaaggaaacttaatacttcatgtttttaaacacaaaaggatattttttcagagtagcagttataaagttgttagtttaatcttttagttcagctttttttcttaccagaaaaataattagtagtacaaaaatttatgcgtttgttttagctctattctgatactgttaagaagatacatgacataaaaacaggaatattttcagtcagtgattacaatttaaaatcatattcgaaatttaataaaaagtttaaaagaaatcaccagcataagatgttgtcatttggctcttggggcaaaccagctctcttctggtgaaagaactttctggatgaggtcgaaaggcaacagaaaacctggggaacaatggctgtctttttaatgggagttgctcctattcctggtggtaacaacctcttcctgttgctcctttccgaatggaattgcctcagtgaagttgttgaagaagtgaggagggcgaaatatgcccatccttctacagtggggagaggcctggcgcatgaaagcaggcctttgtgtatgccgggctgggcccatgcaaacagggcacaatcaggctattgtttgtttgggaaaagctatggcatcctattgcaattatttatggaagaaaatatttgatgtttttggaagaggttaggtgtggggggtgatgagggagggaggaaagagactgggcttacctcttgtcccattcactccaaatctctcagtgcgtaggatagggtccatctggtccaaaggagagttttgtgtgactctgtgtgttggagtgttttcgaaatgcagagaaattcagagcttctctagctttggctagagaaggaacaatggaagtgagtcttattctacctaagtttgatgtggggcagcctgttctgtagttgccttccaagcccttcttctttctgatgctttcttggtaccattgcccacatgctgcctccaccctggatgaggtctagacctgttacattgattctcaactaattaaaagtcaatatggtaaaatatttgcagcattccttctccttccctgtgttcatttctgaagctcaacagtcttccatactcaagctgtggggaggtccctttctcctttgacaccagccattttgtgatctgccctttcaggccaccccagccaccctactttcccagtcttgcctctgcctacttcacctcttctctcgaacctcagaagcttctggagtcttcacagtggccctaatcatgggtctcatccttgttttcctgtctctttgaggttccagcagccagctttgcctcatcaggcctttctctgaaattcccatcaataactacaagatctgcccagtaccttgtgcatatcaggtctcaggaaattgtgagtttcttgtttcattaagcatttttctttccaggaatcatcattcatcgcattgccatatgtgtccagatcccccttttcagggagccagtaattcgaaagcacttgcctgtgttgaatatggtggaaaaaacaaatgtcaaccctagccggccatcactccccatcggcccaccccattctcttgtgccagtaggacttgcctgtgttttctttgggcagttcaaagttgggctcttgagaagttgcctgtaaattcaattgaagtgaccagatctcatccttacccactctgtagctgcagataataaacactggggacttcccttgtgcctgtgttttaatgtaaccttaagacttgatgctccctggagtgtaagaatatgaatagctactcgctgtggatattgcagttaattactccttcctgtcccatgtggtccccagaggaatatgagattgccacaaacatggcagctttctttggggaggtgggagagggagatgaatcttggggcaaggcacattctcataaccatgtggctccagaaagctgcctgactcagagaatggctataaatgcccggttgtatggatctgagatcctcaaagccaggttcattcacttatttattaatttaacaaacattaggcagctgtggtgctctgtctgctccagcagtgatcaagacagaaaagatttcttcaatgctgcgtgtggtggctcacacctgtaatcccagcactttgggaggccaagacaggcggatcacctgaggtcaggagttcaagaacagcctggccaacatggtgaaaccccgtctctactaaaaatacaaaattagctgggtgtggtggcccatgcttgtaatcccagctactcgggagtctgaagcaggagaatggcttgaacccgggaggcagaggttgcagtgagtggagatcatgccactgcactccagactgggcagcagagcgagaatctgtctcaaaaataataataataataataataataataataataatagtaagaatactggggtggggatggtaggatgcacagtaaagagaataataagctagtgatgagcatctaagaagaaaacacaaaacagtactgtcatcacaatgcaggagtgctgggttgggggccaggtgtggttgaggggtgctgtattacgctgggtagtcattgaggcctctgtgaaaaggtggcatttagactaagggagattggaaggtccagccatgggaagttcaggagaaaggataagaagaaaaagctgtcacatgggcacagactgatgaccagcaaggctggaacttggaagatgagggaaactgagagtgattgtcagctcaggctgctttgacaaattactgtagcctgggtggcttaaacaatagacattgcagcattccctctccctctctgtgttcatttctgaagttgaatagtcttccatactcaagctctggggagatccctttctcctttcacaccagacatttcgtgatttgccctttctgaccaccccagccctactttcccagtcttgcctctgcctacttcacctcttctctccagcgtcatggttggagaagcatattctcatggttctggatgctgaaagtccaaggtcaggtgtcaacaaggtctggttctagtgagggctctcttcctggtttgcaaacagctaccttctcactgtatcctcatatagtggtgggagagagcaagctgtggtgtctcttcactgattaaggacattaatccaattgtatcagggtctcacccttatgacctcatttgatcttaattgtctccttaacagccctaccttcaacagagtcacatgaggggttagggttcctacatatgaattggcagggtggaggtgggaggtggccggggatgagacacaattgatttcatagcgtcgagttataagatgggtcacagtattagatgggaccagagcagagagggtctgtaggccatggcaagagtgagaatttactcaatacacagtggaagttggggatgagtgagaagcacaagagtggcacactgatttctacaacagtcagtctagctgctgggtggagaaggggagaaggaggaatagtggaaaaagcagggagaccgcttaggaagctgctgggaccgtgcatatgagagatgttggtggcttgaaccagtgctgggtttctcagcattggcagtattgacgttttgggtgaaataattagttggggagtggcagggcggggggtaggggtgcagtcctgaaccagtgccaggtttctcagcattggcactgttggcattttgggtgagataattagttgtggggggctgtcctgtgtattgcaaaatgttcagcagcttcactagtctctacctgctagatgccagaagcccacccaccccgccccctagtcatgacaatcaaaaatgtatctagacattgacagatgttaacctgggattagggggtggggagaccaaaattgtaccctgttgagaaccactggaccagagtcatagcaatttgcagtggatagatttaggaatatttgaagacttgtaaaatatagcctgaagggaatggagactgggagagtgaaagatacctctgagacattttggcttggacagaacagggggtggaggcttccattcctgagctgcaaaggagtggggagggaggagcagtgtagtttgggaagtgtgtggtggagaaggcagatggggcaggagctctgtcttgcatctctcaggtcagaaatgcctcagacatccagggggggcaagctaagatggagttgaacacagcagtgtagggctcaggggacaggccaggaatggagagaaacatttggcactcatctacttgtagcttccctgtcgagaaaaatgaaatcatccaggggttttcaaattcagtggtctctggaccccttcacactgttaaaaatggaaaaccctgccactgtctacatgtttatgttgccccagtaatctatgcattgaaacctaatcaccatgtgatgatattaggagctggggcctttaggaagggattaaatcgtgagggtgggggacctttatgaatgagattgtgcctttataaaagagagctgctttgcctcttctgctagaaggtgccctccgtgaaccagaaagtggagccctcacaagacactgaatctgccagtgccttgatcttggacttcccagactctagaactgtaaggaataagtttctgttgtttaaaagctacctagtttaaggtgttttgttataggtgcccagacaggctaggacaaacgccaataagctttcgtttatgtgggttgtatccattgatacttgctgtatgaagaattaaaattaataactttaaaaagatttattgattcagaaacagtaacaaaacttaatatgcgttaacgtacttttatgttggataaaaactatatcccaccccagtatatgaatagagtggcattgttttatgtgtttaatctctggcttaacagaaggcaattggatgatcatacctgcttctatgtttattctgctgccaatatcacacagcttctggaaacttccacggcacacattcatgagacaataagagttaaaaaggtaaacagtgtcttagtagtgtatgaaaatagtttaatctcatagaccccctgaaaaagctgcagaatccttacgcgttcacaaaccacactttgagaactaaagatcaaggagtacagttttctcatttttatgctgttcagagtgtggttgaagttcagccatcactagtccttcacggatagttcataccccaagttgatggccttgtggaattgctgatgctattttcatatatatatatatataattctagcctttttctctggtcttataagagtcacatacgtaggtaatttcatatcctacaaatatgttctaaacagcagaatattccaggaaaccttaagtgataactgagttgaaagagtcatattttttaagcaatacaatttaaataatttttaaaggaaacatttctaaaggacgttttacattgcttgcattaaaaagaatataatgaacataatccaactttttctcaatactcagggtcatcactgtgaaagtaacttcattctatgataagataatgatgctcccaggtgggcaaggcagtttttcatctaaggtaattgagacaccttttaaaagcaaaagataaattcacagaccctcagtgtcattataaattacttggtataaagatacttaaatacctacagccttataaggcctaggtgtcaattttttacgcttgcagatcttttacaactgtaagttaaatgattttacacattaagtgcatataaaacaaaaagattcaaacccaaatattaatttaatgacatgggtaatattttgctaaaagtaaaccactgctcagaatgtgaataaactgacctcgaaggcctgagtacgtttgaattacggaacacctctctttgacatcacaattgaattttttctttaagtatcgcaaggccccagttcacggaagtaccacaacataaattggtcttcacttggtatgtgaacacatatttatatgttaaatgtgtcttttctttttggtgtacaacagctagagtaatgcagtttgcttgcaatgtgttttttatgtaaatgctgatgccgaatccacttggcagcactgagttacaagaaggttaagtagatgaactagaagatggataaacgaagatagataaaatgaagaaaaacaaaaatcaaggagaactcaggcgtccaagagtgtgtaaacaacttctggtgtgagacgcgctacattgcgctaaatggcctgtgcgcttctggtttttcccttcctctgttgattttttatagttgtcttttattttaaacacgcctcccccccccctttttaaactgattttaccatcactctctctagccctgcctccctagaattagctgcttcttacctcccttggatctggaacttaaatattaacgtgtatataagttaatagtaagtagaccgtgaatttagaagagtaaaacagaatcatgagtacgtagtcactgtggccccttttctgctggatttcaagttcgtaagcatttttggaagagagtcgaaggggaaggggtggcttgccagtcagttgagtgatgcgtgagggaggcgttaaatgtgcatgatgcactaaaatgcatgtttcgagatccagtatgactgctcttccatagatgatgaaaccaaggcagagaaataagatgtaactctcttaccttgattagtgatgagaatgggacagctttattcatgaaacccggaaaccactagcccattcttgggatgattgatatctgcaaggatcttcaggaatagagtacctggggctcaggagccaagactagaagtgttgaaaggtgagcaggaattagctgctggcctcagacgtggagagacacacgggtgtatgtgtgcacacacacacacaggcacatgtatattcatgatggcttcttaattcccactccaggccaactcatttccctttcccttccacaggtacttataccataaaaggtatatgaagtgctaaaatacttgtaggtatgttgtcaatatgagctactctgtaaatgataaataataattgactggtgagtctaggcaaggcaagtcaatgagattacaagaaaagagatgttaggccttcagaaagatggaaatttctctttgtccctgcagggactgttgcagagcattagagccaccctcaaacagttacccagtgagtctcctcaaagcaagtggcactgagatacaaccttcctacaggttttcaagtcatctcgtgtggtgcacagtcctcgccctacctcgaaggcccgggcgaagttttcctgagtgtgtatactcatctctttgtgttgtctctggcagggagcaagtgagtacaggattggagtaataggcatttttaggcttgagatggctttgtgtgtttggttaatgtcactacatttcctaggggataataaaagtctagcatgataaaagatctcgtcttacaaggtcccgatgtaaagtttggagcctaacttagaatttaaaataaaatacattttgacccattgtattgagagctggtataatttaatatagtgagcccctcggcttctggttggttgggttataaagcttcttattcattcgctcatccattaatgcatttctcctatgaggaagctttttcctttgagctgaacacacaaaattaatcgtgctcgaactctccaaattttgtgagttccctggtaactgactgtatggaagacagaaataaaaatcagaataaacttttattttctgaatcagaaagcagttgctccagcttttggtggtcacattgctaagatgtaaaaaacagaagttaggtgaaataaattaagaataattattttggagaaagagagggtagtgtttgactaaattagaaacattctctgagtcttagaagcgtgaatgatttaaatgaggttccagcatagtattgcatgtggtttctattttagagttttcccacttgaaaacaaactttgaggatttttattgaagtccatcagttttaacttactcaaagcttagcagccaccttttgcttttcttcccgttccccccacctcatgctgtgaagaaagtcatacaccattgtggtgttgattgaaacctttatttctccaggtctcctctcataaactgggctaagaaacacaaaggacatttgacacttcatgactacataagatgtgctgttcctctctctttctgtttgaaagtgacttggcagggtgaagttgagaaccccttggaaaggaggaagccgaaatgcaaacaaagttgaatcatgaagtgatgtcactctgaaccaattggagcagtggtgtcatgtgcctggcagctacttcaaatgcccacaaaacaggagtaatggtttaagctgtttccctcttcccctcccaccaccaatcagcagcagactgctagaggacagatgcaaaacagttattagaccaggcttagttagacatggaggatgcatcttaacaagttagtacctttttgcaaagcatgaagactaattcaaagtctattttctggttttgctctaccagtacggccaaaaccatttctttttaagtgagaagtggggatatggtcaggtttgattccagttgaagttgtgagctgcacagggctggtctgagcccagtggcatctttccaggtgtcagagccatgattttaagctcctgttaaattcacagtgcttagtaaccataacttcttggtttcatgatcataggggtttttgcatagctgccacccccattttctgtttgtgatccagtagttaaaactcccagaaaatatttctcaccctggtttaaataaacaaaacagccaccacaaaaacaaacaaaaacttggctaaccactattttcaggcatattctgagagagaaagagggggaaaaaaagactagacatcctaaaattaagcaacattatttttggaattgtgttgtttcttatactcagtcatttgtgaatgatgtggttcaaacaaaactgaaacaaaaatagtttttctcattaaaaatatgtttgtcgcatagccagcactcggaactagggagggtaacatggaagtattgtcattctcggggctgactggttgacagcagcctatacaggagtggagaatattgacagggctgcccgttctccccaggtcgaagagagcaaatgcacatccctgtgtgcacggccacctggttcctctcctcacttgctggtgagtattgaacggctcacataattaggcagaactcaggaactttcctccctatctctttcactcttctgaaatgccctttatgttttcctctgctctttcagtcccagtgccttttctctggtgcagcctcatggttcggtctcaccttcagcttttccttccctccaatacatcctgtaaattattgtcagacttcttcttatctaaataactcgtttaggtaaggtactcatatgttcaaaataccatggtggctccctgttctctgtgatgtgaagtcctaaccattagactcagctttcccccaggacaccttggcttatcttcttgctgctttccagaggcatgggccattaggctggttttctgaaggttctgccaaaaggctgggcccttgtctcccaccccactgctgttactcatgtgttctcccacttgctcggcattctttcccatgctttttccttgatcatcacttactagctaacatctattttttcctaaacactctgttgcagttgtagtctgcagtcactctcctaagacttgatcatctattacgctgtttcgttctttattttttaacttttcttcttcttttttttttttgaaacggattctcgctctgtcacccatgctggagtgtactggcacaatctcggctcactgcaacctctgccttccgggttcaagcgattctcctgcctcagcctccctagtagctgggattacaggcacgcgccatcacacctggctaatttttgtatttttagtagaatcggagtttcaccatgttggccaggaggtcaggtcgaactcctgacctcaagtgatccacctgccttgacctcccaaagtgctgggattacaggcatgagccaccatgcccggttgttttgttctttaattttacaaacttggcatagcttagaagaccatatacagtggcaccatatacagtggcaccatattagtggcaccatatacagttttccctgagaaaactggtacctcccaacagataccaaaatctgggaccaccccaacagataccaaaatccacagatgctcaagtcccttttataaaatggtgtgatatttgtgtatagcccatgctcatctttccgtatactttaaaccagggatccccaacccctgggccacagaccagtcccggtccatggcctgttaggaaccaggctgcacagcaggaggtgagtggcaggccaactagcattaactgcatgagctccgcctcctgtcagatcagcagaggtcctagattctcataggagtgagaaccctattgtgaactgaacatgcagggaatctcagtaatgcctgatgatctgaggtggaacagtttcatcccaaaaccatccctctcccccacccatctgtggaaaaattgtcttctacggaaccgatccctggtgccaaaaaggttggggaccactacgttagaccatctgtagattacttataacacctaatacaatgtaaatagttgttatcatgtattattagggaataatgacaaggagaaaagtccatacatgtttaatacacaagcatcctattttttttcctgaatatttttgatctgcagttggttgaatccatgggtgtggagccctcagatatggagggcatgctatactgatcacccctatgggtgtgaatgttgggcagatcctccagtgtcaccagccatgtggccttggtgacctttccatacttttcaatcagaatgatgatctccacctctcaggaaagttgtggggatgaaatggtatagtctgtgtgtgtagagttgttaggctggggcctgccatgttaaatgcccatgaagcaggtaattatggtagtagtggttgatatcttgaaatcagggggattcccaaatttctaccccaaatctggatgactgcatattgcgggagttcagtaaatatttgttgcactaatacttatgtgcatacgctgaaataatctaaatatttaaaaaccaaactaacggtaggactttcctcagggatttaacgtttgctgtagaagactgaatgatagaatatataagctgtatttttcttgtgattctacacattgtccatgttgcaacttaaatatttttggaatgcaatgtaaaagtgatttactgtcctataattgttttcctgaaagcaaaatgatatttaagtgaactgcaatgaaaaatgcaacgactgtaatttatcgttgaagggcattttcaaagtgtatagaatgactaaagcttaagtgtattaaatattctagaggaagacatatttaggctataaatctagacttcctttggaatttgtttcctttttctcagccaggtgtatgaagattttaagttcttaggcctcagtgggaagaagatttaaggttccaagagtacatttgtatctcttttaaattttctattgtttatcagtgacatatgtaaatgttttagggagctgtttactgtaacattacctactttagctctgtgcagttgtctggcaaccaatgtgataaagacagagggaagtgctgtattttgttgctgacaagtatatcttaaaagtgcaggtgcacctgaataggcaataaagtattaagagctgctcctggagcagtttgctctctgtgacgtgtgaaaagtctacggggtttataattggtctggccatacggctgcctaggattagactcttttcatatcccactaaacactctccttagaagcaagcacaaggagatagtttattttaaaatgtaattgctatgttactaagatttgaatttgagtaccgagaataaaccatatttctgtttagaggctggttggcttaaaattgtgtctaatccttcccctgccccccaactccgaatcagagaatgaataacaaataaacatgacaatgaagtctcatgctgttgttttcatatttgtatttaggagtttcagagcaaatgacttggaaaacaggcaaatccactgacataggcatttttagccaccttggaatccgaggagggattctgcactatgccctgtaacctcgttcacatgccgtttgaatgtataccatgaagaccccttagctcagggagctttgctctatttaagtaatgtttatattcttaatgaaccaaagaggaagtggtcatgggaaaagagccaggactagatttcattctaatgcttataaggagagttctaggaaaccctcagacttggtaaaccaaggcatttggagatactatgaattggtttaaaaggccatttaccacttcttttgtaattggccttttaaaccaactctcacttagctgattaaatgtggtcatttaaactgctagttaacaatcggaagtgcagtggcgcaatctcagctcactgcaacctctgccttccgggttcaagcgattctcctgcctcagcctcctgagtagctgggattacatgcgcacgccaccacacccggctaatttttgtatttttagtagagatggggtttcaccatgttggttaggctggtctcaaactcctgacgtcatgatccacctgcctcggcctcccaaagtgctgggattacaggcatgagccaccgcgcccggcctaagatttcttattgtggtattctgcagtggagaatgggagttggaaagaaatgttttctcccacacctgtcccgctcctgtctactgaaagctgattaatcagtcagatagtgagttcctattggtagtacgcctccaaaatttggaagaggggaggtggcgtgatgtgaaaaagcaaggctttagggagagattcccgctgggggcattcaccctctggtccagcgtgcctgttacagtgatcactccatagtggttttgcatgaacaagactgcccagtttgcttaggaagaaaacaaaggacataaggtagttctcatgtcttcccagcaccctaaatactcgggctaaacttccacagtcagaccgtcagcttcaggaagggctgctgttgggaactttttttttagtttgcagttagttcagctccagccaaaaacctacaaaaagccactgcaagccctctgcctgctcgtataagacaccttggttgggcccctgtgactgtccatccataggatggttggccattgactgcacagagaggtagggcaagataaaacgactcatttgtggatctgactccttgtacttctgtttggattcaaacagaggaagatagagtagtggccttgggaaaccgtggagagagaaaaggcatagtcagaatgttttcagaggagcgcagacttttcaaaacccctctcatcacgttcccactgaccttcagttccagtgctgtggccacagggtgtctgcaccccaacttctttgccaagaaattaatgatctgtgaagacacacagacatgaggcggacttactatttaaaggaatcctgaaacgaatatttttctgatacatatttatcctaatatatttgctgagcatggtttttttttttttttttttcctattttggagtttttgggttttttaagcctagggaatgcctaatatgtactgtggagtgcatttgttcatttatatcccagtgcattgtaaaatcgagcaattcagtgccttagaatcctttctgtgaacttgatgctacgtgaactacttgagaacaactactttcaagccctccgaagcactcagttacaactgtcggtctaattgcacattattctaattcattaaaaaagtccccaagggcttcttaggatactgctctatgttattagaagtccttccaaatagaaaaactttattaatttaaaaataaccgccaattcagacttcgattcaaacaaggcattttaccaagtccggctgaaagagcttcttaccacatctggcatgtagaatggcagaagactatttttgctagattccttgttgctgcagccgtttctgatgtccttttccccttcacacctttcgtgttacacatgtctgagatgacatgatgctaagtaaccaaagtactgctgcgatggaattgctctgatgtttttttccagagtgaaagctgctattactttaaaaaaaaaaaaacttgaggtttggtttctttccccctctatccgggtgttatacaaatatgtaattaagatgtttgggggttcagatgacaaacaaggagtctacttctaagaatgcatttgcaagccaaaagagtggtgaaccacttcagagtgcgggtctgtgggggatgatgtctgctttgcttcgttttgtggaataatttttaacatttctatttagcattcatgatactctaaatagaagcaggagaacactgtggctctcggatccaggagaggcaggccacgagggctcctgctgtttggggacagtctgtaactctaaatctttttatatgcagcaattatgaccttaaaaatgggtgactctaatactggcattcattgcctaaaaataattttaatgtgcaaatgccagagaccaggtcatctcagaaatggactagaattgaccactgctatgttttggtgaaacctgataaccttgcttttctccgtgtaccttgtttttcattgtaaaactatttaattatgaaaatgagagtgtgaaaggcaaagtatgattgaatttagggggcagttccatatagttgtaacaaactgattatcaaatgtccaccattagtatgttaaaatacggttttctaatactgagacaacagggatggagcagcctatccactgaagtcttgttgtttgtccctgctgtgtcccaacctggaatctctttcttcttccttcagcagacccttcgagatcagcttaagcttcactgccttagagaaactttcctgtctacctggactgtcttctagatttctagagcagtgttcctgcccttttcctttctaaatggggtgggagttctcagagaactcatctcctttatggctttatccatcacagccacacagataggttctgtctggaccatccttttccctgagctttcttctcctttgccatgtgttttcatttctgccagacactggcactggggaagcctcccatcgtctcagactcagggtgtgtgaaaaacaaacctgctttctggactctacagtttgtgcactagcctaagccgaaaatcttgaaatctgtcatcagtgactattgtagtccataggaatacccaagactgggtaatttataaagaaaagagggttagcttttttttttccggctcatggttcttcaggctgttcaagcatggttccaacatctgatcatcatctttttttttttttttttagatggagtctcattctgtcacccaggctggagtacagtggcgccatcttggctcactgcaacctcccacttctgggttcaagcaattctcctgcgtcagcctcccaagtagctaggattacaggtgtgcgccaccacacccagctaatttttgtatttttagtaaagatggggttttgccatgttggccaggctgatcttgaactcctgacctcaggtgatccccccaccctggcttcccaaagtgctgggattacaggtgtgaaccaccacgcccggccaggatctgatcattttctaggaggcctcagggagcttttattcatggcagaaggtgaagggggagcagttgtatcatggcaagaagagaaagagagacgccagatctcctggtagataactaacagagtgagaactcactctttactgtggggagggcaccaagcccttcataagggatccaccccatgacccaaacacctcccaccaggccccacctccaacaatgggaatcacatttcaacatgagatttggagggaacaaacattcaaactatatctacgaccaaattttcctaattcctttctacttaaatgctttcttttccatttatttcacccacatctgaccctaggatttcaacgtgttctaaaatgaatttcttgcacccattttcactttctctccaccagaatccatctcaccacccacctgccagtggcatactccttgcatagaccctgctctagcatgaatatagcccactgttatctgttgtagaacctcacgcccagcttcccaccctgtgtgacatcttcaccctcttgccctggcttgtgccatccacattccgatcttgatgactctggttctcttctctttgacggtggagggttgatcccttccttccccatgatcataaaaggtcatgccaacactcctaaaacaaaagatagattaataagagaaaaacctaacaaatttattatatgtgtgcatgggagtcatacaaaatatgaaaactcaagaaaatggccagatggttgatccttaaatgctttatttattggtgagaaggtattgggggtgtaggagtaaatgattttcagggaaaatgaatatttccctgagacagcaatttacttgtaaatgatgctctttagaatttgaacacgctccagaggcagaaattgtcttgtgaaaaagtctgtctgggtatggttgcattcctcagtcttgagctggtggatggcagggtgcaattgcaggccgtagtgttcctctttggggatctggtttctaggtgggtaagggaacttcagagaacagccttgtcctgtgctttgcgagagacaaaggatgaggaaggggggtcagggaccttgaggctgcttcagcatgtcaagagtgccatgtttgggacgcctcaacactggaaatagccttcattcctctgcttcttgggtctggatccttttctttagactccaagaaattcttccttttgccccaaactcacattgtttttgtcttctgtccctctacttctatgtaattctattattatgcacagattctgtgtgcccaaggagactgtaaactccaggagggcaggaattatgtcttaaaacactagcggttaaacagttaagaggtgtcttaaaacattcctgtagccccagctacactcttgggtgcaggaatcacaagtgccttattccccacagggtccccagcatattccaggagctcattatgtttttaaatgaatgacctactgaaggcaagagaccaggaaggaaagtttgtaaaagtttacattattagattacccctgagatgtgtaaccttctcacgagttagatttcttgaaccactgcccgggtattgtattcctactctaggagcttgaaggattaatgataatccttttacagatatattcacaagtttctgtgaatgtgaattaagtatgtagatcttgattgcctttcttgagtgcatggtttttttctagaaaaacaaatttaagttaggtgggacacctaataaagctctaggctcctttcttttcctcttttaagacacagttaattaccttatgctaagttggaatataggaattatcttccaaaactgtgtttgcttgctgtgtctacataaaaattgatacaaggtatgccatggtttatacaatttctggcacatttacctggtctctgttacaggtttgtgaaaccaatttttttattgtaaatagtacgttaccagcttaattgctttagaacctagacagtctatgtctgtgatagtaattacattctttcatgactttgtttggtaacctgaatgttgaactagctctacagatttaggtcatgtctgatgctagccattcctaggaaaaagtggtgaggactacattatgggcctttccccctagacttaaaactgtgaagaagtcattttgggttgaggtatcccctggtaccctctcctgaacttcaatagaataacatgatgtggtgaatgaaccatattagaaaaaccagccaatcagccaagattcttgtattgactcttctgatctccctctacctctcctttccccatctgccaaacaaagggtttggaacagttaaattctaaagtggtgtcattgatggctctcagtattctgtggactttcctggttgattcagtacttgtgattgacctggaccccctggtttggtccagccttagagcgggtttgcaggtagacaccttcctaatgtttgttccacgtaagcccccggagcacagtatttccatcagctattttgtggaagtgagcgattctcttttggttgtaaaccttcactatttcatgtgggtgacttgacaatggctccatttttgaatggcccattgatagttgtagtctaaaaatttccagagattacacaagggtttatttaaagggaatgggaatagggagaaggtataacctttccaaaacaatctttaaggcaattataagctgttaggaaatgtcatgtaataataacacagatacccaagcttatatcacataaatcattcattttgcatgtttttgacagggagatttattttccaggttaaaaacaaaaaagaaaaatcttaaaagcttaagcttttattgtttgctttttttattaaaaagtaatttggagccagtaacttaacctgtttttcataaacatgctatctagaggcagccaaaaaaatattcatgcttgcatagtcagggtcctcaaatgaacttatgtgttggatcatgataactctggtaattactcgaattacccttgttgagtaatagtatggaccctgaatacaagggtttgatttatgtggccagctctgtgctgctgggtttatgaggacttgccagatgtcatctcctaattaaaatccttctttacccttaatatcctctcctctgtccccaagaaattaatccattctattgctggagcatgtaacagctgatgttgaagttacaagtttacagcttgaactttgcctagactgtaccttttttgggaaagagtttgcaaagcttttaagcctgactcttgtctttagatcaccagcatcaccatggtgcctggcatcagtggagcctcagcaagtgtttatggtggaaacctcagaagctgtcactttctctggctgtaacagttgtcatctttgtttacagggaaaatgctcttgagaaaatggaggtcattaaacactccagcttcagcaatatcatcagagctttccgtcacgtgagttatctcacaaaagggtcagattctggtaaaaactcttgccttcacacttacttctgttttattttgccttatttgacatttcaccagaattgatccataggttcaataaggctccattctgttgggacaaatcaagctagaaagacactgaactctgggggttaccagaaatatctgaaagcaaagcagtgactgtgaggtgggaatctctctgagaatcctttgcagaaccatgtaacagctctgcatcactagacgagccaagcgaagtggtcctggatggttcagtaggctcaagcattgagggtccagagcatcctttgcccctggacatggaagggttttcattgggagatggcatttagggcatccttataaacgagcaggagtaaacctagcaataaaaaccaaacctctgccttcagaggtatatgctattacttctgcttaaaccgttgtcagagctaacagttttggttagggatttttgtgggtccagggcacgcccagacacccagatgcttctctatgtttgtaagatggcgagtgttgagatgtcttataggcttatattgagtgaaaaggaataggatcctttgtcagtagtaacttaggctttttaggtggccagggcaagagaacaccccccctacacacacacacacacacacacacacacacccctacacccacacacacccacccctacacccacacacacccacccctacacccacacaccttcccacacaaacctacacccacacaccttcccacacagacctacacccacacaccaggatttgaaggctctgctaagaggctacaacaactgtagcatacaactagcacacttgttgctattatgtgtaggggactagatggaaagagtgcagataggactacctaccattcacccctaccagcgaagtggaagcactcatcttctttcccttcttaccctttcaaagcaagttgttgagggatgaagaggagagtgactttaatcgtggctttaagtagagattttctttaggagtaattgtttctctcgacagagtggataggcttccatagttgtcttaataccttttgtccaccccaaggattgacccaggcaaggaggatgaaccctcctcaatttgggaaagttaaattttaggcacagcaggtcaaagagtagggaagagctgcagttgttggaaccaagtgacattgatttagtctggaaaggagtcacagaggaatcaaaagccagaccctcctggcagctttagatgtggttggggtctgggaataatgctggtcccaaaatcacctctggaactaactcctgtaaaatgaagcctctgcatccttcagtaacttacttaaaattttgttagggctgcattttcttcaaagccaagttctgaataagaagtatttgttttgggctctagccagattactgaagtattgttgagggagatttgctgtggaaggtgttgggggtacagggattgtgaagataatgtaaaatatttaacattttaaaaattttcagtaagttctctttccccaatgtcagcatgacttcttcattcatgttcttccatcactctccattcagttagaatctcaattgtgtaatatcagtggtagcgacaattatgaaattcgtccagtgaggaaaatccgcagagctagagcccaaaccagcaactttgtagtgaggatgaccccactggccggggagaaactgaactgatttttttttttctctctctctcagctttttattttgaaataattttagacttacaaaaaagttgaaaaagcatccaggcatggtggcttatacctataatcccagtgctctgggaaaccaagacaaatctcttaaagccaggagtttgagaccaagctgtgagactatctctacaaaaaaaaagaaattaagtagccagcagtggtggcacgtggctgtagtctcagctacttgggaggctgaggtgggaggatcgcatgagccaggagttccaggctgcagtgaactatgatcatgccactgcacaacagtcttggagacagattaagaccctgtctctttaaaaaaaaaaaaaaaaaaagtttgtaaaatatcacccagttttccctaacgttagcattttacataatctatacaccaattctcacagccaagaaattaacaatgacacaatactgttaaccatggactatttgaatttcaccagttttcccactaatatcctttttcagtcccaacatccttcattgtgtttacttactatatctagtcttctccagtctgtaaaaatgtgtctatctttgcttgtttttcatgaccttgatatttttgaatagtatggacaggttgttgcatagaatgctccaaattggttctaatgtttctcatcattaaactcatttttatacattttggggaagactactacaagattgacattgcatctcagtgcgtcacatctgtgtgatgtcagcatcttaccactgatgatctcttagccttgaacacttgattgaggtggtgcctgccaggtttctccagtgtaaattttctgcttttcgcattgttactgatatcttagggctgatactcacagtatgcagatgtctcgtttctcttttttcatatttcttttcttttttctttttttgagacagtcttgctctgttgcccaggcaggggagtgcagcctcagacttctgggtttgagcaatcctcccatctcagtttcccaagtagctagtgtgcaccatcactaattagtgccccaccagttttgtttgtttgtttttttgtttgggcagaatctcgctcagtcgccagactggagtgcagtggcgcaatctcggctcactgcaacctccaactccctggttcaagcagttctcctgcctcagcctcctcccaagtagctgggattacaggcaggcaccaccacacccagctaatttttgtatttttagtagagacggggtttcacatgttggccaggttggtcttgatctcctgaccgcccacctcggcctcccagagtgctgggattacaggcatgagctaccatgcctggccttcaccaatttttaaattttttgtagaaactcactatgttgcccagtctggtctcgaactcctggcctcccacctcagcctcccaaccacaactggccaaggtcctgtttctcatcacattgtcactcactgatcttgtcatgctttggtggagcttatctacaataattattactgccatgctttaatggcaattttctatcttattgtcatttattcattggaatttttacataggaaagacctgctccttctcaaactctaaacagtttcattcaccatacttttctccaggtaactttctgggtggctgaaagtgactttcaaagaatggagatatcttttcaatgttgagagagtggcagtctgctggttcccaagatgccttcttcacctagcattgagactctgcagaatgccttgaccacagttgtgatttggatctgttggcttgcaaagcccatttgagaatttacaaaatcattttcacggcctgagagtcttttaggtactgatttttttcatcccttctttactaacagactttatttagtagagtattattggacaggtttggggttcacctttatgagaaaaaacttagattttctaatttcagcttttttattttcttccatcagtgggacaaagttgacatcattgcctaaaagtaatttctgtgattatctgtgtatttcagttaaccatgttctttggactcactgtggtcttcagcagggatggtggccaaactatgtttagaaagataaaaattaaaatgacatctgcatccttcatgtaaacccataaaaaatagcacgtgaccctgaagatcctctgcctctcattccaggcattacaattgaaaatgctatctgggatgttaaaaactaaaactattctaggacttagtggaatattgatagttagggaatgctgtttgctttcttgaattttgaacctgttattgagaaggtagatgcgcctgtttaccccaggaaggctcctctttgaagacagtgcccctggagcacatgaccttttcatgcccttgcctgtcaagacttttccagtactctaaggtcaaagggcgttgggccaggctgatctaatcagggtattaaccttgccccactcatcttgatttattcctagatcccagttcccagagcatccctttagagcctcagaaatggaacaaaagacagctgaaataagcccgtggccaaaaggcactctgagcatgagggaagtaagcaggcttccctgtcactgctgaggctctgtcatccagccccagctgtcctcttgtgatcactcagcagacccgggaaaaattcaagaatttgttttttagtgtcagtgggagacgtggggatcctgcttttgctgggagagcttcagttgtctgagtccccactcaaccccaggctcctgccaaggccaccaagggcaggagcactggaaggctgactatggagtgaagaggccactgggtttcacaaacagcactgtcagccaaagctgtagcttgttagccatccaaaagaatcttgcacctgctgccagtgagcttacacctagatgacagctggagctgacactcattcagcccttactctatgccaggtactattctaaacacttgccatatactcagttgtcccacagatacaactatttatccccactttagagacaaaaaattgaggcacagaaaggttaagtaatttggccaaggaagtgcagctagtaaatggcagacctggggtttgaaccgaaatcagtgtgactctagagtacctactcttagaccctactctctactgcctctcattagaagtctcccccacctccctaccaccaccatcaccacccaccctcccagccacatatatgctcacactgggtggttcagatggctagaagtggcagctcaaccttgtgtgcctcggacacgaaaatattaggttcagacaccactcagacttcacattttcattagttttgggtagaggaatgagaataaatattcagcgagacagccttttctaactgcaagattgcattcctcttctttctagatgcagtggcaagaacagtaccctggatggtggagctggtagtggtagatgagatagagcagtcccttgattctgctttgtccccattaatgacagatctgagggcatccagaaggaatctccacaagcccagcctccacagtggctgcttcctctacatggtagagtggtgctcacctccactcctccatagatgccaagtcatctgtggtatagatgtggatgtctttgttcaaatggtccttgagtctttgctcagatgatccttggttcttcatttcacctgggaaagaaaataatttgcctgttgtcattttatccataatattaagaaaacttaatggcacaatctaagctttttaccatgttatttatcatgggattacttttttcaggtgtcttctgaacacgcagttgtcccaccaaactttgacactgcccttgtgattaatttttgcctacattaatcactctcccttgttttaattgcacattacattcttttctgtccttcccggacatctttgctagcacagtgagtgcagggaggactgtcacggactctctcccctcttgaatgggggcattccagcagagtgtgttacatgagctcagagcacatgatgtgagagcctcgtgatgaaagatactgcaaaaacagtgcgcactgttatcaaacctgactgccttcacatcttgctttctgtggtgcaaaataaggtttttatagtgtcctgtttcttctgttatcatctaaaccaatggggaacggtgagtaagtagtaatcttcagaaaagaagaaaagacagggaggagaaagtgtactggaggcctgctttaccattaagttgttaagatggagtctcactctgtcaccccggctggagcgcagtagtgcagtcgtggctcactgcaacctccaactcctgggttcatgcagtcctcctgcctcagcctcccaagtggctggggactacaggtgtatgccaccacaactggctaattatttatagagatggggtctcattttgttgtccaggcggggtttttgttttttgttttgttttttttttttttttgaggtggagtcttgctctgtcaccgaggttggagtgcagtggtgcaatctcagctcactgcagcctctccctcccaggttccagcaattctcctgcctcaacctcccgagtagactagctgggattacagctgcgtgccaccacgcctggctaacttttgtatttttagtagagacggggtttcaccatgttggccaggctggtctcaaactcctgacctcaggtgatccgcccgcctcggcctcccaaagtgctgggattacaggcgtgagacactgcgcctggccgtccaggctggtcttgacttcctttcgcttgtagcctcccgaagtgctggaattacaggcgtgagccaccgcatctggtctctaagttttttttgaaagtgtgtgtgtatgtgttgaaaaacaatcttactgccatcatattgaagttacctagtgcatttcttcttcagggtacgaagaaaaaagaaaagtatgtcctgtggttgatagaaatcagtaaaatggagccctgtacgaggaagtgctgatgagactccaactaactccatggagatgagctacaaaaaaaaatactgattgggttcaaatccttggcctgccatttactggctgtgcttccttggtcaaattacttaacctctctatgcctcaatgttctcatctctaaagtatggaaaataattgcatctgtgtgaaaactgagttactatacgtaaagtttttagaatagtacctgacatacagtaagtgctgaataagtatcagctagagagagagagagttagtttccagcagcctgtttctgtttggggtcacatgtggtctctgtccacctggctttttaggcctctcttacctgttccctgtttatccttgcctgccccagggaggagtttgagttggtacatcctgactgggtactctgcctgtggttagcaaatactctgcatgttgagtgctttcaaaatacagaaacaaacaacttgtggaggcattggaaaagtgtgtttgagaaacaagcagcctcaccatgaatgggagtttgtttccctttctcgtctttctggtcatctgctgcacgggcaggaggagctgtgggttgcttttcttccttggaacatggagcaccactctcccctgtgctgatacacttacaaagaagttcacctactccttggaaagttctggaaaaggggcttctacactgttggcctctcgaggagaacggtttttgtttctgtcttcctggaaaagaggtgactgctggcatcatctttctagataaactccttgctatgatgccattagaagcagtgttcttttgtgttttgcttttgtttttccctgtagacaggaataacattttgactagaaacttccctgatgtaataacgaagatggcctccttagaaagttccagaacagaccccttcacctctgtccccagaagcagaagtaggtgatgcactttcttggcaagccacataactaccatttctctacaatcgaagctcaaaaatctgtgcttgtatacgttcattttttgtttttacttctttacttcctttgataagacagaaacttctgtattaaaactgatttaactctgaggggctaagtgaacaacaatctgttgtcctatagaggtcaaggcagtgctcacaacaggatcattgtgctgctgtagttcagtttaggggacggggaatgtttataaaaacaaagttttgaaatgaggacagggaaaggctttgtttacctggggctctagacttaaggtactcattttgcctgcagaataatgaaatgcagagttgtaattagaaaaggttgatgtaattgatgtgttaacaatttttgaggtttttctctttccactttaggacagtcatgcaattatttttctgaaccaaaatcagaaccatcagtcgaaggctaaaacaggcctggggaaacactgtcttttggcaaagaaagacaaagatccttgttctctaggccagtgtgcatatgtgtgtaatgctttaaagaacaattttgacaagaactcttaggatgcaacttgtagagtgatttttaaggagatgcagtaggatttgtgcaagtattctgctatgagcctaagattttcaacatggaaatctagccatgcagtgactcgttcactttggcagtgtctatcttagtctgggggtgagcgtttgtagaaaatatttagagactcaagtacactcatttgaatttttgctgttagcaaataaatggcaatatgtgtaacgtggtgaatgggatgtaaagctgtctttatattaccacggttagaatttaattttgaaagttgcaagtcaaactgcttcctcttgcgtcattaagttgtgcctcttgtttgctcaccggcatgtgtgtccttgtgtcattttggttgctgtgaaattgctcttaccattctttcatccttcaacctgctgtgctacaatcctaacatgctgtttttgttgaaaatgcattcactctttttggcatcttttttccccagaaagttagaatattgggaattcattggtattagtgaaattcccacctaatgcagcagtttttttctcttacctgcataatagacgcagaacaaattaactctaaacggattagagctgtcaactgacagatactgtgcgagatactgaggaagcctcagagatgataccaataaacaggacagggccttctggtcgtgtttctacttctcttattggtttgtcttagcaattttgaattgcactgaaaacgaaatttcataggtacacgatacagtagttagttttaaaagtttttaaaatattaaaaaattgaaagtatttaaaatatttttaaaatattttaaaatctgctgtgtgagatagataggagacctagcttttcttccttcttaccttgatccatagagaaagcaaccctgaaagaagaaaaactcacccatttgagctttcttttgtttccactgagcaatacggaagaaattcaccgctggttataggtcttcagtgctttcttcagagtgggattgttttttgtttcaccataagtagtagtctattaaattaacagttgctagagaagaagctgcatctatatatgcagttctcttcttgtcaagcagtatattttcacgatagcaatgaaaaaattccatcctcaccagccgctgaaacatagtaatactgcagaaattcctgtgaactatgcgtttgctgcttccttttgtttgtttgttttcagagcagatgggcttgtttgctttttgcttaaacattaatcaaaaatcaatttatggctatgtaagtggcattagataattctcattctgactacagtaaataatatctatttgttcatgttagataagtctgggcggcagtggaatgtaaaatagaattacatgagatatgacatatggctatgtgttttataaattaatgcttttatgcatgtgggaggagaagtaatttagcttactgacaaaaagaaaagcaaaggaaattccagagaaagaacaggataccaagtctaaataaatttggaagacaaagagaatatcatagtttagttcaatcttttaaacaaattgtcacaatttatacgttgggataagagaaccatgagaaaaggtatattctaagtcctgaacatctttctataccctgaagatgtttttatagctcttctgctgactccctgccaaaaaaactatttacggtttggggtagggggcgtgtcatgccatacagctaaatacacttttttcctaatctaggaggcatgtctacttacaaataaattgcttaaactagttaggcttgtgtaaatgtaactgacatttccttgagatcagaaaaagttttgctgattaactatatttgtgtgtgtgtgtgtgtgtgtgtatttagagagaaggagggattttataattattacaatttgatttgaaatgtctagagaaagtgagagattatggaaattaccataaatgctccctttttcatagatttagatctgttaattgcaagaaatctttttttaagtgaatcaatgggaactttttatttcttccctaagattcatttagccttgaaaaggccaaaagttgaatgaagcttctaaatgccaatctttccctccttctgttaaagagtatgcttcaactataattacatttgcattgtttaaaatattagtaattctacagccagacctctgagatagctgagaaaccaaaaagtgaagttcaaagacatcatcaggcaccctctccacacacaacataccaggcccaccaaggagtttacatgagtgtttttgccttgttagccgtggaacgacctgggcagtacccaaaacttagcaaactcttcttgtaccttgtattcagtagacggtcagtagcaccgagagtagggagaagagtaaatatgtttctaatactttattcaatgtatgttgttaacagtgtagacactctgactttccttgtgaattgcgcctcagtatttagttttcatttaccctggatcagatagggcatgataacctttgaggggctttgtgcatatgtaatttggaatctgagtcagtcgggctgtgtctctcccaacttcccttctcatattcttctctctcctcctcctcccctccctcctcctcgcctccctcctcctccccctccctcttcctcccctccctcctcctcctcccctccttccttctcctgccccctcctcctccctcctcctccttccttctcctcctcccttcttcctccttcctcctccccctccttcctcctcctccccctcctctctcctcttctctcgtttctcttctctctcttctttctctcttctctctctaccattgctgtcagttgagatgggcctgtgcggcactttgtttgcagttgattggcaatcttctgttctactactgcatctgaatcatcacttgcttccaccagttctctgaatgtcttacctagtgatcctggtggggaaattacagtgattagtgttccaattcttgtttgcccataagtgtttcaaagtagtatttttaaaaactcttctaagacattctctcttctcatagtagatgcagtgaatcttaaaggtgccctaactaaaatttttgtgctataaaattggcagctttacaaaataaaaggttcgagatatgagcctgatcaaggctctgcatttgcaacaatatccttggtttgcctggccctgttatattttgctgttgtgatatgactcctgccagtgctatttccatttaacctttgtttttctaaaagacagtaataatttttcatttctagggagtctctgacatcagctaaaggaaagacacttttctttgactgtatatacatttctccccatttcattaatatcaaagttgctctttcaaatggcttataaaattttaaaattacaccagttgcataagcctgcataaaaagcagactcctacataagctgacaatgcatttgtaccgtggtgttgagcagttttaacatcctccgtgcctctgtgcttctgctagctactgctctgataaagttatcaaggtatcattggatgcattgaccaggatgaagacacaacagtatggccttattaaatttggaaataatgaacagacgagtagagaatttaggagcaatataggcaagcttaataggtctttactttggggcctgtaactccaactacatatggaagaatttaagtacaggaaaagttaagctcttttcccagtagttctgctgacaagttgggtgacttcgggatggttacctcttcatgataccacacggtgatggtaacagaggcactgtccagtctctggttcatgcacactggtcttctcaggggtccctgtataggtgacacagtggagaacagggcagtactgccagactcagggacccagttcatcgagaggggcagtgtttctcttatgctgccttaaaggcattggatgccttttggaaagccagtggacaactcctgcatccacccaagattaatgttaacagcttaaagaatcattgcaatcaagggaaattttgcaacactttgttgggatatttttaaataaatgtgtgaacaccttgttttaggcttgctgaaaatgacccaggaattccttgacccgggaatatagtgtatggctgccaattattatattccttcatcagacaaaggcggaacagttcactctttttcttttttttggacacaaattctcactccctcacccaggtcagagtgcagtagcatgatctcggctcactgcaacctctacctcctgggttcaagtgattctcatccctcagtttcccaagtagctgggatttcaggcacgtaccaccatgcctggctattatttgcatttttagtaaagacagggttttaccatgttggctaggctggtctcgaactcctgacctcaagtgatccttctgccttggactcccaaagtgctgggattaaggtatgagccaccttgcccggctaccggacagtccactctttacaggggggcgtcttggtataagtatggaaagctccgtagatgccgtgtcagtccataccctcaccaccttcttgaccctgtgccgataaactaagagatgtgggcagtgtaccatctggaaaggaaaaggctttggagccaggtagtcctgcctgcatttgaatctgctttctaccacttacttacatcaggttttccttgtctataaaatggaagtccttgtacccaccacctagaatggaagtgaggattaatccagaccaacgatgaagagtccagcatgcaggaaatgctcgtttataaccatggaagtttcgaggacttttgaaattcgatgacattaacctttgaggtgcattttagttggcttgtgtgatgaggcctttctacttctagttccagaatcgtctggatctacattatgtgggaatgtttattcccccctttactttcccaaaatttgctaaacattttcattgctatttgagttttttaggagacatactgagatgaagttagggatgtgaaaggtttactgaggataacaccaatgaaaggaagagaggaggaagatgatgggtgtggggagcggtttgaccaggactctgataggacagacactctgccagccctccgggagctcatttgcagagccccctgttagatggatataaccgggccctgggaccattgctgggctcagttactggccaggagctgcctaggaagagtgtgacctaggccaaaagttgaagtggaccctagaagagctagcagctggagggcatctgctagtgacactctggagctggacagcaagtcctttctgaaagaggatctgagctgagtatccctgtggtccagtatttcaagttggaacctctaggtttgaaaaatacatgttttgggtgagagtttgattattcttaaagggacatatctttcaaacatatggctgtggaagaggaaacttgtttttgacttgtaaaataccagcagagccttgcagtgatcacaacttatgtgaaatacagaccatcacccacagtttacgtgttcacactaaagtgccagtctctctatgggttttagagctgatttagatacatgcattgctaatacagtcagcccagccaagatagtgccatcctccgcaagcatccactaaggcatggagtcagcttccgtcattgttagatcagtacttgtttctttcccttgcttatttttcctaacctctctgaacctgctgtgttggaagcttaaggaacatcatcctctgttgggcagaattcttccatggccaccccagcattatgccccacaccatttgacttactcatttgtgaatgccaactcagaatgtattgctttgattcttgattaggatctcaacctctatttattgttaagactatcaccctttgattcccccccatcccattgtgtccttctaaaggcacagaatagaacatcttctgccagaaataacatacaaatttatcatcatacaactgtacaatatgcaaataacttgctagatgatattactgaagattctacatccaattaaaataaaaagagaaaacaccttaagataaccatactattaaaagatacagaagacaactggaataaatggaaagacataccacatttattagacaggaataatcatcattagcaagatggcaagatgtcagttctccgtaagtttttcaatttaatataaatccaaatacaacagatttttttcttttagttagattctgaggttatcattaaaacaaaaacaaacaaacaaaaaactgaacaagagcaaggagtccttaccaggtattaaaaacttccatagtgcctaaataattaaaatagtgagataccaatagatgaagagacagaccaatggaacagaatagaaagtccaaatgtagatgcaagtacctgtggaaatttagttattcgataaaggtagcttcacaaatcattgggactaagataaactcttgatttactggattggggcatgtaaattatggcccaatcatgccatgtttcttttctctggaaaagaaagtaaattaggttcatacattataccatgtaccaggctagactccaagtgaatccaaggtaaaagtgtaaacaaaactatgaaagtcctggaagaacacatagcgagttcctttttataaccttggagcagagaaagcctttctagtttcaactcaaaatccagaagccagaaaagaaaacattcataaaaattgaatttaaattacaaaaaaactttctgcatggccaaaaaccataagcaaagacagatgccaaactgagaaaaatatctgaaacttctatcacaaagagctaatctcccttgtttaaaaaaacaaagtaaaacagagctcctagaaattgttaaggaagaggctaacagttcaataggatttgggatgaagtattgaacagatagctcacagaagaagaaacacaaatagctaagcatagaaaaaaagtttgatttcactcatacgagaaatgcaaattaaaactacaccaagataccattttttcacttctcatattggaaaaaatccaaaatatttgataacacactctttggaaaacaaccccacatggctgggaggacggcagaatagcacatctatagaggagaatttggcaatatctctcaggttataaacacgtattctttgacccaccaatcttagagggggcatttaccccatagacttgcacacatgtgaaatgacagttgtgcagttgttcattgtagtgtttcaaatggcaaaagatgaaaatgtcccccaaattccatcactgagggaataagtaagttagggtgatagctcccaagcttattttctcttcagaatcacctcatgaagaaaatgaaggtctgtgtgatagtagctggcaggtgggcatggtggtgagggtggtgtttgagcggagacctgaatgaaggttgagaaggagccagccactcacagacacagaggaggccttcaggctgagagagcagagaaggaccctgtggcagagacaagctggaaacagcactgcttccatggtctggagactggaatatgtgggttctgcagacacctggggggggcaccacctggtaaatctgcctttcagctcttggttcttccagcaaaccatgccagctgtggctctgtagccatgtcctcggaagatggcagaggttgcaacgaggcctctctgaggtgctctgggagcacagaggagtcaggtggaacttgtggcatgttgccaagggaagaagtgatttttagacagaataggaatttgccaagaagagaagtcagaaaagcataactggcagaggaagcagcatacgttacaagtaactgcatgtgtacagggaatcactgagtgatggacaagggcttggcacttggtgggggggggtaccatgttaacatgttagcaagaaactaggtaggggtacttgacttgggggcagcagaagcaggtgtgagtgttggacaagacgagaactgagtgctgcaaatgtttggcaagacttgattgagtgcatattgtggacctgtgtctccactggagacacaaattagaatataacaccttgccctggtatgctcagggtctactgaggtggagaaacctgcaagtagagtcggagtacagtgttgaaaacaccatctgcaaccttaacacagtgctaccaaaaccgatttcggagcactcctgcaggaagtgggctggccagggcaagggaagccgtggagaacagtggcctctcccgggcaggcagggtaaggcctagaaagaataagctgagtgaaggtttgtgtgtggcccatccagggacctgcgacaggaacacagcggctgaggaacggatgcttggagaggagggggtgctttacatgccaggcgggcagggccggggtggggccagatgctggaggagagggctggccaaggggtggcagagaggccccccaggtggcaagtttgcaccctgttgcttcctgcaaggagcttttgtttacgttttcagcttggacagtctggctgtctggccaagagtgacaacgtgacttaccatcagagcgaagcaccaaagagcacataaatgaagtggagatccctcctgtgtccagcctccccctccccgtggccttctcctaccttcccagtcctccatcagtaccccggggccttgccagaatctcagaaagaatctctggactctggctcaggacctctgaggtgattatgcatctagaggcatccccaggtgctgcccaatttggggaagcagcacttcccgctggaagctgggaagtttcccctggctgggggtcctgtgaggatggagaggccagaatgaggaatgggttgtgagtcaagaccaaccagaaggggacttagcaatgtcagatgatagcctgggtgaactacatcctgtgtggaaaaggcaaggtgtaactgcttatttcttgtcaagtgagcctaatatcatcatgtttctttttatgcctgctcccaaactcagcccctcccagtgagatcacagctccaggaacttgcaaggaaagggactaacggggcatctgattcacccgtgtgcccttaatggcgtattgtgtgaataaagcaacaatttttagtacagggatttaaaacaacttctgcaaagacagaactaaaaattaatcttaaaaggtggagggttggggtggagggcaggaaagaggaggaactaaattgccattctctttggagactttctaaaacctaagacgaagaagaggagccgaattatggaaacaaaacctttgcggttttccacagaacaaaaatgatgtgaagctgcaagtcagcagttctggcgcaggggctccgggggacgcccgctccgccggctgtggtgtgcgcccttcctgctctcccctccgaggggctgaggctccttttgtctggcgcgcgcgccccaccccgccccgggcgagggaagagggagcgggcaccccgcgcccgcgccgccgccgtggaccaaggttgtttactactttccactccgaataacacgccaatcaccagggcccaccctccccgccggccaatcgctgcgttgggaaattccacctttccgcggggcccgggcagcgactggctggagtgtctgtcagtcaagtgggcatcccgcaaggatgcagcaggagtattagggaggcgatcaccagagcagaggaggagtaaccttccccataaacaagatgtgttccccccactaagaaagcgggtggagggtggaggagccaaaacacatcccagccccggggccccaccggagcgaagcgggccgagcgcagagtgcagagtcggggaatccctccctccgcctcccgccgtcgctgcagttgtaaacacgtttccctccatgtctgttttcccttctctctcaccgtggccattacgggctgctgtttacaaaaatcctgcaggcctttgacaccccgtcctcccttcccccggcatccctgcccttattctggctttcttctcttccatctcctggtgagcacagcatactgttctcaggcttgttttccttttattgctctccatgtgggacaggtcatgctttatcaacatgtaccattttctacaaatgccgcccttcctctttaaattgcttggatgggcagatcgattttgattagcaacactgcagcagaaacaaggtgcatctctggaaggactgggtggttttctcgttattgttgctggtttgggtcacatcggatgctattttaaattctgtgttttattccacgatgggtcttgaatcctttccctattcctaggtttgaaatatgtttcctccctttaaaaaaaagaaggggggcagtattgtgttgaaccaaatgtttttctaccttctcctgtgatctgaatcaggtttcccatttccagcagtacaatgtggttgtattcagtgtgataggggcgtagtggacatgaattatttgcgacagggctgcctggaagatgcggagcggagtttgcgtggcccggagcagctccagtgtctgaggcttctctgtgtcacaggctccaagcaggaagcgcaggcaaaatggcaaaatacagcatgtggcattcagttcaaaaatgcccttttttagaagtcggtattctaaatgacatccagtcttgcttagttttttaagagaaaggaaaaataatctatgaagatggtttggaatattttgtgaaaagccttttcagcataaaaaagatgatcttgagggtctggtttgcggagtggaggataagcctccctcctgcgattctgaattgctttttggtttgtaggaatttcaggaacatgttgcaaagccgtggccgcttgaaagggtcggtgccctgcgccccgtctcagcccctgcggcccctgaactttttcagtgatggggcacttggggagaagtgcggggagtggaggaggaggggaaggtgcattgcaaatagaaatgtaaggcgtggcctgggtggccaggatgtgccagagcagcctccagacctacttaaatcccaggaaaagtcctgcctcaagttaggcacaacatctgacttggatttctctctgtttttttctcttccagttgtctgtctgtgcgccctctcccacaaggaatagttttccacactgatggaattaatgcatatcgtggtattattggtggaatatgtttaacctttgtttcgtgatttgagaggaatggttcttgtgtatcgtgtggtgacagcaggttaaggagagtgtcagagctggtgcagagttttgccccggggccatgaggttctgggcatcatgactctcttatgaagttacaaaactgggcaagtgattgaaggcagaaagacactgtaataaagtgtgctccagtgatgtgtgctccggcttctctcccttactcatctgggccaggtgctttcgccacagtgagcctgggtgtcccctgcctgagatgagcacagtgatgtctatgcgaggttgtaggactcagtgaagtgccttagggattttgcctggcactctcctgggctcatgaggtgcctagggctgagacttccccttctctgtctggtaaatcatctctcccattctttcttctgcggcccttcatatgagctttgtaatttactcagggtggcagggtgaattcatcttttgctgggtttctgcatcacctgctcctttctggccaggtcagcctgttcattttttccatgccaacagcctctaagtgccagtaagtcacgtctgaacaaccaaagcatgtttccctgcgggagaatgccagggcaggcgggtctgggagccaagaggatttctcctgttcagataagtcgggggaatagaagagccctgtgacttgagacaagctttgagtgacacccagtgaatctcccatcactactttaatccctgccccagtgttctggttccccctttcctgcatgaggcagtacgagtaccctggcctggctttgggttctacacggtctgactttagcctgccttggtctttgttcccctctcactccctccacccctgccccccccaacacatgtggagtaccttaccctgccttcctagttctggaatggctgcccctgtgccaggccaccccattttctagaaccaccttcatacagcccctgcgcatcccactgtactatttccttgtttgtttttcctgtcaatcttgccttccgcgctaatgggacactgatgctgtatggtgatgtgttctcccacagtcatcttctcctcctgtggttggggtggggagctttctctgtgtccccccatgagagtgaggacagtctcatttaatggcaccatggtctgtggagccaggcaggcctgtgtgtctgactccacttcagcgctctcagccagcgtgggcacctcggacccagacagacgccccgagcctgtctttctggagaaggaagtagtaataccttttccttgagggagttatgaggattaactgtgcctggccctgaattcgtgccttgcaggtacttaggaagtgagttattacaagcagtgctttttatcatccatagatggagatgttatctatgctataggactgcagaaagaattacagagaattatgtagaatcactagggacttgattaatatttgtttacctttcccccacatggattgatgtcctttattatacttttgtacccccgcttggcaagcccttgacaaatattgatccaacaaaaaattagctctttaatgtatacgtttagaacctgttgctttgtcagtagtggtttttatgaaaatgaatgcttataggtcagacttctggaaaccctaatctgagggaattgggccaaataggaaagtgagccccttaaaggcagttgtctgaccagtacttggagcacaacaggttcttgctaaagcactgtgtttttaaaacagtggagttattaggttgaaattctgaatagcaagaaaaagaataatggaagtgctgccagccccgtgatgctggtgcagctggtcagtttgcagaaggaggccagttactagagcagagtggccgtagaggctgcaacacggtggccaaagcatgaagctgctgtatagtggcaaggtcacagtgatttccccgcagcctcggtttagagggagacggggtgtgctgagctgtgcctgcttctgtagaaggggccttctccaagtctgagtagccttaagccattaggactgctgagtctttctccacaaaaatatgtgggaggcctgcagggcaggtgctcaactaagctctggggctgcaaagatccagagccatgcccctccttggaggcaggtccttgtagacgaggacaatcgtagccttcctgattaaagcaggaattgtccaatcaggctatatgacgggcatcgtccatagtcttcaccaggggagcttttctgactatacatctctagccctgtggcttgagccagtcacttaatttcccctgagctttggtttcctcctcctggtagcagagagactatcagagtgaggggcagatgcaatagcatatgtaaaacacttagcgttgggcctggtgtttaactgcaataaatgttagctcatattttactgtgacatagatgctgtatgccttttgctgagtattaaagatactgagctgtagcatgcatacttgcatgaatcagtctgctaagttattttaagtttgcatttgaaaataaagggtggattgctatccaaatataaagaattggaaccaggctctaaaaggatgtttgctgttctttagcaaaataccattcttcttaagtttcattcaatcattccacaaaaatttaagcatctgttttgtcccaggcaggcactgtgcttgtaatggatgtgcaatagcaaacagaacacttgctttcagctcacacagagctgactcctgggcagagaatttcgacagtaaagaaatacaagtgtgatgaaggagaaaccctttggtactacctgctacatgttttaatatttaaatgttgacttagggaggtctttccatctaaaaataatgatttgccctttctcctgtaaatgacccctttctcttaagttttgggtgagagattttttttttttaaggaagaaagatattctacaatcgaatgtacaactgagataatgcttaggagagaatgtatactgggtttgtgccttggaagttgcttaggggaaacagttgtgtgcagttggaaagctgatgctttaaagaagcttctataaagtgaccccacaattaaactgttttgtgtacatctttatttatttatttatttattttttaattgagacagagtctcaccctttcgcccaagctggagtgcagtggtgcgatctcggctcattgcaacctccacctcccaggttcgagcaattcttctgcctcagcttcctgagtatctgagattacaggcatgtgccaccacacccggctaatttttgtattttcagtagagacggggttttgccatgttggccgggctggtcttgaactcctgacctcaagtgatccacccacctcggctttccaaagtgctgggattacaggcgtgagccaccacgcccagcctacgtctttaaaaataaatgtaaatacccaaggctcacagttccgttcttccatctagtctagcaccgtccagtggaagtttccaccatgatggactgttctgtggatgccctgtccagtacaggagccgctagccacatgtggctatggagcacttgaaatgtggctagtgctacggaggaactggattttggatttttttaaagttttaatttaaatttgaatagctacatgtggctaatggctactggacatcacagatctaacacaggattaactgacaaaattctttcctcttaaaaatatgtgtttattttgataaggataactgagacctgtacattccatttttcctgtcatatttagggctcataaagggggtggtatgcacgttttaaaaaatgcaacacaaccagttaaaccagctgtctaattgtacacatttcctggagctgttggtgttgattattagcaaatactaagtacttgtaatgacctaagaactataagacaagcaagtcgtcttctgtaactgagtatcagcggattcaagcgttaaggaaaatgattaagagaaaacaaccaaaaaagtcttaatggttctgtcaatcaagtggctatcaattcatggctattcaaaagcttttgtggctatgaaaataaactagattgaaaaaattctaaaacaaaattgaaacactcatttgagtttaaaattttagttgagttgatttttatttcttgttttggttcatttgtagtttccccccgcttcgttgtttcctcagatatggagaataaagcctggctggtcagtttcagtttttatttaaattcattttgtcttcattccttttaatctagcacagtcctgtgatgtattgggatcacagtgctctggggaaacattgaaatataaaaacattttcctgaaaacatttccagttatatttaattttcctccttgaatagaaaaatatttccaacttaatcctccctctcccctcttgaaatgaattgcatgctttggaaataacatcaatccacccaagtacacaaggacaatctcagccatttaatcgagatataaaggcttagagaactctgggcttcggaggcacagactccacctttcaggatgctaataaacgtggacgaggtctcgcctgggcttcctcctccattgttcagcgcagcaaaccagcacagcactccgtggccagggtttgcggggagaaatctctcactctgttttagtagcatcatcatccttatcagcaccctgcttttatttttgaacagccaaacttcctctttccaaacttcgtgtgacatctgggaccagctatgtttgaaggagtctgaacatgccacatagtggctcacgcttttaagggaggaaggccagtaagcctcctcaatggcagaattctactttcagtctaccctttggttctgttgtggttgttccttagaactttattctgctcattaggaagcccagcctccggggagggtttagcttctcatctaagcaagaagtaaaatgtcataatggaggaaaaaaaaaaaaaagtccaaactttttttggacttttagaaacacatccagtttgagctccactgagctatcattgcagttacaaagcccatgtatattgagatcggtgtaaaaattcagcatgtccacctgcataattatgaccagtgtattgaaagcacatttcatttagttttgcaacagccgatgaggtagattctaccaacattgttttacggaagaacaaatggaagcctggaaaaataaattgtctacctcacacacttcgcaggtggtaaacacaggatttgaactaagacatacttgattttaaagtgtttgcttttcctttgcactactgcatctgcgatgtttgcactcagacactctagaatatttggtgttgcatgtttttgccccaagaaagaacccattaaaatgaaactttccagttcgtaagctttgccctcaagaagggaaagaacttcttgcaaggtttctgaaacaaaaagaaaatgaaaagtaactttactgtatctgggttttctgattaaattacggtttttgcaagcttgtgcatttctcagtgtccagatagccaggatttttccttttaataaatatcactttaaaaaacaaacacacacattcttaaatgcatgattaactgtatagattgatttagttataagatgtcctagcctaaatataagaaggtgtatgtgttagaattaatttcttcaataaagagaaagaaattcaggaattgtggttctgttggtcttctgtactgtatatttttgtgcagccaaagcagcatgccttgcttcttggtttcatgaccacatgggtagtttcttgaagttttttcttttgagatggagtcttgctctgtcacccaggctggagtgcagtgacgcgatctcggctcactgcaaccttcacctcccgggttcaagcaattctcctgcctcagcctcccgagtagctggaattacaggcatgtgccaccatacctggctaatttttgtatttttagtagagacggggtttcgccatgttggccaggctggagtttcttgaagtattgactgatccttgactctgaactgtatgatcaaagacttttgaaatggcacaccgtttcttaacatttaggccaatttcagttgctcatatccaaaaataagtcatgattttcggagtcagtgcgcagcacttagtacaacaatccaaacccttgtacagaccatcctagtagaaatgtggatcttgagtatctcagcttcttagtagattttgaactccgtgaaagcaggagccaggcctctcacagcaagtctctccaatatgctcagtaaatatttgtcagatcgagcaatgaccagatgatgaaatacattaaagccttagggagaactgagactactgcaccagtttttgtgcactatcatgctggaaatctttccaacatgtattctgtacttctttgcttcttactccagtgaatataatttagtcatttctggccaacttgaggacatcagcgagcataaattgttgtattatgcataatacagtgataccctcaaggctgagtgggaggcagtttgccctctgctgaaggtttcttgtgcttattgtgttcttatggtttggttttaccatttttatgtctccatttctgtttaatagacttatttcagtaagaagagaaagccgtctccatcagcccctctgtaggtgattatttgccacttcctttttgctgtgagtgctttgaaaacagatttctaagcttgttagagttatgtgttaagagtaaataggcagtaagtgaaaccaagcttcttcctggtgcttgactaccccagaaatgtttatttgctgaatagttgagttctggaaaggtgaggtataaatgtgtgataaatttattcctttgcatgatttttttttctttttcttccctccctccctccctccatctatgtctctgtctttctctgaacatctctccgtctcagtctgtctctctcatgatagttgctggaataatttaaatgaatgtaactcatttacccacatcgaagcccaactcagtagtgaaaaaacaaatcttccaaatgaatgcactttccccttgatgtgctatatacaagaccttggcacacctagttcaatgacatagtattttagaagggcctccttacaccttcctctcagataaatatacatgcagggacattctgaagaagtttgttatcggtcttctcccctcctactattagctccgccctcctagtccttctctttcaccatgctgacccgcgtagggaggacccttacaccctctgcatgcagcgctggtgctccttagtgttcataaccccaacctccatggcctctctcgcagttctcaggttaggccctgcttctaggggacattagctttccaccctctactacatacttcctagttgttgcagcctttgcaagcaaaacttgttttcatttgggagacagcatggtctgacagagcctagatcctggggtgaagacattctgggtttgtatcccgtctttaccacctctgagcctctgatgctggacaagtcagcaagtctttgcaccttagtctcctttctgtaaaaaggagcttatggggatgtaatcagagaagccttagcatggctcttggtacaaggcacggaccaaatccatggtacgctcactcctttcctttcagtaatactgcctaaatagggcacatgtacctaaaaggattttgtacattccttgacagcagaattctcatcttctgttgcatatcccataatgctgggaacacaaaataaaaatggtagcttttcacattcacttttggcctcaattttttgttattccccaatgaggatcatttcatttggggctggtctccggaaaaaagtagatcaagcttttcagatgagatttgggtgaaaccctgacaaactcttttttattgccttccctaccacatagtggtggatcaggaaactgtagggcttatgatgctgggaaatttctgctaatgcaataaagatttttgctgttgaaagaatttgatctgttttatgtataacatgcagagagcagaagcatatattatctgtagcagatgatagagcagggtatatgggcaagttagaaaaacacagttctcactacatttgaagaaaaaggacaaggagttgtcacaaggatccaggagagtcgcacataattttctgtcgtgcattttgttgactgttcctctttgcatccttcaaccatcttaacttcccacttgcacctcgctggaagacaaatctaagctaaattaaatgctaggcaatatgtcagaatggaaagggccctcaacttgggatgcccggttctctaccagcctgaataaactccagcaacagtatttctctaggaatcatctgtaaaaagtagaggtttgtcatatctctaaactagggattcaccttatttattaagctatcagtgactttatcttgaggtgcacggcttttagtaactctggttcaagtgcaaggaatgcaaagttaagtgtatcattggaggtgggatttttgagtttgtcagtcatttattgatttgcatgtatccttatagttcaaaggtctttttctcaacttagttgatgatcatgctgtaagttgttttcttttgctttatcaacttttaaaaacgtttattaacttttaaatttgaaataatttcagacttgcataaaggttacaaagagtaccaggagttctggaacaccctccacccagcttccacagatgttaacatcttacataaccgtaatacggttatcaaaacagtgttcactccatactccagtgctgttaatctccagactgaattcggatttcactattttcccactgatgtccctttttttggttccagatccaagagacgatcctacctggcatttattgtgttcagtttttctaattctgggacgttttcctgggttttctttagtcattcacgaagttcgcacttttggagaacatggggccagttattttgtagaatatctttctgttagagtttgtggatgtttcctcctgattaaatttggggggtacatttttaacttggagatcacagaggtgctgctgtttgtgtctttgcgcatcctgtcaggagatgcgtgatgtttcctttcctggtgctgttagctttgatcccttagttaaggtggtctctgtggcttcctccattatcattactatttttctctttgtaattaggaagaatcttttggaggtagatacttgagactatctaaacaagcattctgttcctcattattctttcacccactaattttaacatccattactgtgatgtttgccaaatggtgattttctatttctgttttctacacttagtaattggattctactctcaggattttatgtattttttaacagtgagggacataaactttttaactagcagtggcaagtccacttttatttgggaggacaattactagtcacatgaagaagaaaaaatatgcagaagcttaagaaatcccacatatgaatgttatttgaaatgttcttgccctttctccctacaaaggaggtgaagaagatgacaggagatgttaattgccaaaatagtctcatagttttggtcctggctgcaaatctctcgtttttgatactcaagagaatgctattggggaactgactctgaagcacagcccagatgcttgagatgggttgggaaggtttacatcaacaccatgaatttaatttatcatgtgacattttatttctgagtttttaaagctgtaattaaaagaagtgttcaaagtgttgctttcctcttttagaataaacgtggctgggtgtggtgcctcatgcctgttatcccagcactttgggaggccataggcaagaggattgcttgagccaggagtttgggaccagcttgggcaacatagggaaaccacatcactacaaaaaaaaaaattagcctgtcatggtagcatgcacctgtggtcccacttacttgggaggctgaggtgggaggatcacctgagttcaggaggtcaaagctgcagtgaggtgtgatcatgcccctgctctccagcctggacaacagagcaagacactgtctcaaataaataggcaaacattaccaacatggcaaacaagttggaggaggccccctatttaattaaatttcagcagtcccaaatctaattggtatgaagaaatcattattcagaattttccatcactgaaatactaaaatcacttgttgtttgagacatcttggcctgtcacccaggctggagtgcagtgttgctctcatagctcactggagcaggagcctcaacctcccaggtttaagttaatgctcccacctcagcctcctgagtaactgccactacaggcgtgtgccaccatgcccagctaattttttaatttttcgtagagatggggtctgtgttgcccaggtccctcttgaactcctggcctcaagctatcttctccagtcggcctcccaaagggctgtgattacaggcgggagccacagcgctcagcctaaaaataactctttagccaaaagaaagttttaaaaaattgtctgttgtattctttgattttactctatgtggtcttttctattatttttaaaataaaaaagatttatactcctcaagtgtaacattttatcaaatctcatgcttctgtttgatgaaaccgaatggctaaattttttaaatatcatgcaatccatcccagtttgtaattttattatggccctcacacaagagcgtgcaagctatactaagcttcctgtggccctcgtttttcctcactgatatttgtaactcattccaaattaaattttaggagtctgaaatgtagctgttatatttgggagatgtgaagaaaagaatcgtaggcatctcagtaggctaggtatcagatcacacatgcttgctggaccaaagaggactccttacagtaggatacatgattctgagttagtttgtgtactaagtatatactatatagcttttgaaggggagacgggcacagaattcacaatatcatgcactaagggttattttgtgtttgcagtttccagatgaatgttttaaagttggctgcagaatacagcgagataggtaaaatctatttgagtattacttacagaccccaaaggatatcccaaaggatatgttggactaattcctaaaatatcctgtaagtcattgcaggtacaggcgtggatctgggtttggaaacgccgcctggatcgctggctgggctcctgcagccgccaaggaggggctggctggaggtggggctcggcgtgcatagcggccacgtgactgcgccccggccacgcccaccgtccctcacgtggtcccaggccacgctgggcttcggcatgtgctaaagtggatagaaaagggagtggggcccgggcgtggctttgtggtttgggaagatatgaactccttggggtttttttctcttttaattctttaattttgatatttggaaatgcgtaaaaggtttttcatttgtccttgaccacgtggtccaaacctcaatttccctagcagaacgcggtttcgatcactggtggatccgtctcacagcaccagtcatgctgcctcgctgggaagtggagggctcaggattcccgtggttcacgatccattttatgttggaaggaaatcattttgaactatctcagtacacaccctagtgtatctttaaacctaattgagtgttgatggaaaatctgcggtccgagaaccgtaagaaaagggggctcccacctcccgctctggggtcgccacttgcctcgcaggcaggaggaggctcccagagtagatacaacttgcccgtcacccggatgggttggtagtgcacatatgcacggggcgcagtttaaaatgaaagtaaaagatgcaaatgtgtttgcaaaagaaaaattaacataggatacgtgcgggcgttctcagttgaactcggtcttactgttccacgcgagcaccccatgactcagagcccaaatctcagcggaacagcccaggacgctcctgccgtccacaggaagacgcctctgtctctgtcccccgccgccaccacacagatgcacgtactctcttcacttccgtgtacccagtaaatgcagatcctgatttaaatctgcagcatgctgctttcttcccattgcatgtgggaagcttcaggttctcttcggtttattttctcatcacctttattaaaatgcagtaaagcaaggagtatattaatgcgggcctctgcaaatagagggaatttattgaaaagcagaatggcttgaaagattgaacttcatcttaaaaatcagaaacagactcttgttattaatagctttagaaacgaaaatctaacttctgataaattatttcagaggagtggttcaaacgtgtagtagatagctctgcctggtcatcaattatagtgacgtccttgcatcagctccagaaactcagaatattcatgagctttccagtctgactcagaccttcaggagccatgaaattttcctgttgggatgagaggaagcgctggcggtcgtttcggcagcttaatgaaaccagaaatagataagcacgagtgaggggtgatgtccgcttgtttgctcccatcatgttgtttttaatgtgtgaaagtgaaagttttaaaagtcatactaaatgtgtgatcctttttagaattcactgggtacgggtacgtggaggaagtgtttttgtttttgtgaatttgtttaaacaaatgactgaggctttgttttccactctgtctggccaagcaccattgctacacttttttaaattcatgacatcctgagcagtgaagctgttcttcagcccgcctctccatttgtgactggaagacaaggaggcagacaccaatggcgcctctcacaatggaggtttatttttttttaatctaacggagggattgtagatggtgtaaaacttccttgtgccaggagagaaagggggagagagagagagagagagagagagagagaaataacccattctaaacaactttaggaatagatgatccgtaggcatcaactttgcgcagcaacaaaagccactttctgaacctcgttctgtgaagttttaaaacaaattgggtttgtttaattaaaatatttcttaaaggcaaaaagcactgagctaatttttaagaattttaagttatatattaatatgagtagtgatttataattttctgttgaaatacataaattcgagaagccccacccctaccacttgccagtcttgagtccccacggctcctttgcctaggtctaaagtcactgcttgcacactcctgccttgcatatgccttgccatcgtgtgggcctcttggctggaagtgttcttgtcctcccgttaggtatcttttatgacgtgaatccttacctctaattattatctgtgtgtacatctcatcacctgcatctgactgtgtgccttgtgtatgtctcttagccctcacaattgcctgacatgccttacaaacgggtagaccaagtgttaaatgaacaaatatttaataagaacttaaaagctttttgactttatatatttttaaagccattgtgattaaacactatgtttgatgtggtgctaattctgtgctttatcaactgtgtgaattgtagtatttttaaagtaggaataattgagaaatattttgaagttaggttaagcatagcagtaaagtttccactttttaaaatagccaaatccaggccaggcgcagtggctcgtgtctccaatgtcagcactttgggaggccagggcgggcagatcgcttgaggtcgggagttcgagactagcctggccaacgtgacgaaaccccgtctctgctaaaaatacaaaaattagatggttgtggtggtgcatgcctgtaatcccagctactcagagaagtgtttgaacccgggagttgggggttgcagtgagttgagatttcaccactgcactccagctggggcaaaagaatgagtgaaactctgtctccaaaaaaaaatcagagcgtggtggtgcacacctgtagtcccagatacttgggaggctgagatggaggtcaaggcttcagtgagccatgatggcaccactgcactccagcctggacaacagagtaagaccttgtctccaaaaaaaaaaaaaaaaaaaaaaaagccaaatctgttgggtttttttttttggggggggggtcctttagaatggccctgacagatctttaaggcatggaaatgagccttatgcaagctcctggcaatcagtatgtgagttctgtctccttggcaagatacagcctcttagaccctcagtctggggaaataatgctgatttctcctacgagttacgagaattacgctagaaaactctgtggcgcatacaggtgccctgtagcctgttggttagaagcactgaccctgaagtcaggtcgcccaggttggaattccagctctgccttcttcaagctgtgtgactctgggaagtcacacacactctctctttgtgcctcaggctctggttctgaagatgggaacggcaggccctccctctttggcttgttgcacagatgaaatctgacagcgtatgccaagcgcttagcacgggtagcagtgagtgccccgtaaatgttaggtaccttcctactactactaaacattcattcttcccttccctgctagtacctgcagctctgactcatctcacacccttgagagaggattatcttcattaaaaagtttttggtctgcccagaagcaagtgttacctgtgagagagctgggcttgtgcataggttagattatttctttgggttattcctggggaaacctgcaaagaaatgcagccagaggcctctggttcattttactgctcatctcctaaaagtggtttctcagatttttatcctttttttctctttttcgaggaaggggcaaggaaatattttttcatattattcttgtcatcgtctatttatttaataacagttgactgttgaaacataggaaagtacttatccgccaggaaactcccttctattattggacttacttgctttccatttatatgttgtctaattccaaagagatttcgagacagctttcaattaaaaaaaacaaacaacaacaacaacaaaaaaaaacaccacataccgcatgggtattacacaggacctgtatggtcaaattggcaacgaccacaccacatgagaaggaagattattcttcctggaacctggctcccttgagattcttttttttttttttttttagacggcgtttcgcccttgttgcccaggctggagtgcaatggcacgatctccggctcaccgcaacctccacctctcgggttcaagcgattctcctgcctcagcctcccgagtagctgggattacaggcatgtgccaccacactcggctaattttgtgtttttagtagagatggggtttctccatgttggtcagggtggtctcgaactcccatcctcaggtgatccacgcgcctcaccctcccaaagtgctgggattacaggcatgaaccaccgcactcccttgaggttcttgtaagccaaggcagaagaagagacatcttaaagtctgtatgtgcacacctgcctccccccattttatatacaattcaagggctttgcttttggaaagtttgcctatgtagtcgtccagggctaaattaacacctgtctctatctgtgtgtaaggctctctgggaggagctgtgaggcaaataaaaataaggaatggtgtcccgcaaggagcttacaatgtgtgcattacaagtatatactgagcatggccctgggaacacagtgaaaaaacaggattcctgccctagtacagtgtacactagtggaagagagagaggcagtaaacctaaaagtaagtcttttaaaaactgtggtaaaatgcacataacataaaatttaccatccaaccgtttttatgtgtacagttcagtgacagtaagaacattcacattgttttgcagccgtgaccatcatttatattcagaactcttttcatctcgcacaactgaagttgtacctattaaacagtaactcctcattctctcttccacctaggccctggccaaaaacaaaaataagtctttgattgtaaacacgatcagtgctttgaaggagatgggaaggatgttatcataaaatgatggggctgcaggaatggcacctactcagagagggcggtcaggagagacctcttgggaatgatgacatccagcaggcaggtcattaaggcatctctaggcaggtccagagtgcaaggaggcataagccaggcaggtggaacagcgtgtgtgaaggcccagagtcaggaaatggtctgcttccttccaaggaaaagaaaacagccagtgtggttggagcaggggctaggagagaaaagatgtgcatgtgtgtgtgtgtttgtgtatccccatcatgatttagtactgtcagcgcttctgtgttctgaacctggagtacaggcagacacagccgcatcccagaagctcaagagtgcccataccaggaaattacagaaatctttgccaaatggatgaatgaatgcaacttccttgatacagggtcagagaggggaaatctgagaaaagcaggtgggcaatgtactcctgacatactcccttccgttgcaatggccttgagtgatggagcaagagtgaaggaatgttcccatggcactggcaccaggatgactttttgtgaagcagagcagttggtcttagatagtggaggtgcgggaggcatgagaactgggcagtctgacggctgcaccagccagttggctgtcctttccacctccatgcccaggagctggcccagggcgcgcatgcacaaagccagtgctcttttcaatcagaaaacagcctgcgtatgttcttgcttgcaactcagatatccagcccactgatccaggaagagattcctttgacctgggaagtcataatggcagatatttagacccagctctcaagcaagcctccaagttgttccggtgaacccgtaactttgagtaacctctgattgaaccagagagtaggaactaggtgcagaaccttgttgaatagaattgtttagcatcgtccatttgttagagcatttcaggatgcctgtcctaaaatttggtatcataatggtatttacctctcactcacctccatctcagcccagtaattaataacaagggacttgcttcttcacctgtttctttattggttgtaggaagtcttttccttaccacagaggaaggagcttctggatccctttgctacgtccagagagttttcatctaatctgggtgtattagtccattttcacactgctgataaagacatactcaagactgggcaatttacaaaagaaagaagtttattggactcacagtttcatgtgactggagaggcctcaaaatcatggcggaaagtgaaaggtacatctcacatggcagcagccaagagaagaagagcttgtgcagggaaacttccattttaaaaaccatcagatcttgtgagacatattaactaataacagcaagggaaaaacccaccccatgattcagttagctcccggcgggtccctcccacaacatgtgggaattataggagctacaagatgagatttgggtggggacacagagccaaaccatatcactgtgtaaaagttgaataaagttatttaggagcacattgtattgggagtttgtttgtttgttgaagagccaagtaaagtcattggaagcatgggaaacttttttccctgtctaaaaggaactccttcctagtggaagttgaaagctttcttggcagcctcagcccccaccctacctccaccaccccagtgggtacctgcatcctgaagacccttcacaatagcatctgaactatactgggccttcaaatgatgtcttgggtaaacccatgtccaacctgcactaaatgaagattattttcgagcgaatggattgaagaacagtgctgaaaaactagaatttgtaatattttcatttgagcagaggtgaaatttgaaatattttagaatcttgtcttatgattttttttctttctttgccacatagccctcccctggaaattaaatctgtggattactagtatatgaactgatcagagacatggcttggggtctccccatttacccacttcccagcacgttataatccactggacacctccaaggatgagagaccagcgggtcataatgcgagactggacatctctcctaccccatgtacacttcagctgagcaggcagaattagcagagtcaggactagaagttcagtctagggatcaaataataatagtagctaatgtttaaagagtacctaagatccgccaggagacatactcagtatagttccgtggtttgccacatttcatcttataccagtagcacaggtgaaatttgtcttatgtgtatactgaggaaaacaagtccctctgatacacagcagccaataaatgacaaagctgggatagaaacttacttcattctaacccgagagtccctgttcttgcatgggcacagcctgccatccccatgctctgcctcctaagcagaggatgaacttaagcatcttaaaattttaaacattgactttccctaaaaccaattaaaaaaaaaaacaaaacagacagacagacatgacttgtgcccttaaaaatgcagccaggctggcatataaatgggcgtaggctgtttctaaattttttgctttaaattttgccagcatagcttctggactggtagttttgtttgctttttaatatatttttgacactgtgtacagaggaatgctacctcgcgtcatcatgtcctcctccctgaaggcaagccaaggatgtcaaggggccacttcaggggatgtgcaccctgaaggtaaagctgctccagtgggaggggttggggtaaatgacaatgttagcagctggtaaatttttttacatgggatatctcacaagacttattgatgcatgttatacgtaataacctgaggcacatcaacattttccactttttcctattctttctgtattttcactgatactttttttcaaaaaaatctccaataagtttaggatcagcttcaagatttctctttaggtaaatagatttgtatttttgatggccatcctagtccagtgtaaagatatggacaagaaaccccacataaaggaagcaagatcgctggctgctttctctaggtagcttgagttgtatactaatttgtagattatttctcttcatcgaaaaaacaaaacattctgcagagggcagtcatgtgtccgctgtgcctctgctcctgtgtgcaccataaaacttgaaagtgagccagaatttgaaaatatcggattgggatgtgatttctttaagcctctggctaatttaatataaagtgtttacacttcatttttctggcagtggattttctatgtaggtggtggaagatttcctgtaagttttgcaagttccagggcaaagagagttgcaatatgcaatatctttctgtggtcacaccaacagaaagggcgatttcttaacctgctgcagttaccatgtgtgtaggtggatgctggctattacagatggtatcctttcaaccctcaaaattgttgcaagttcacaggtatgttaatgaaaatgaataagtggcatttttaggaattccaaatactgagtcttggaagtagataatcttttccctaaatgtatgctccggtcagaactgctgcctaccacacctcgtgggtgaaacagatatttcgagcatgactgagcttattaagagccctgcggcgcttcctctgccgggggtttagaaatttcaaaggatgggggttgagggagggaggagttatgggcatgtgatgtggacagggcgggcaggaggatggaagtaacaggtccaaaatgtatctttggtggcccggcagagctcttgcatggggtgagaatggtaatttaggaagagcaagtcttcccatctgtgaagcagaagaaaaaagtggacttaaggagaagttcgggtgctgtttatttagataggagtaaggagagtgcagttggggaaaagcacttcagaggctttacttagactagcagaagtctgtttggcagggtgggaagcaagtgcagttgggagaaaaacgttttcaataggcagtttcagaattggaaattggaggagggcagtccatttcaacatttccaacagtattaaagaaaatttgcgggttgtttgtcaaaaggggtcatatgctttaaagattgagagatcttttcggtgaagtaggggagctggggacatcgtgatgtgacaagagccgtgggctcagaggctggggacctgggtgtttaacccaactcttgtgagtggtgtggctttcatagctttggttctctggtcttcactttatctgccaagtgaagacatttgactggatgtcgtgatcttgagttgctttcagctccagaattcgaagaccccttccattgggcattcatctaatttcaaagatgctccctggctccagctctgcagtgaagcagaacaaactgatacagcctagcttgggggtggggagtcggccctccttttcccctcccttcccaggtcctctgggtgattgggggaaactgagaagccgttctcttctccagagcactccatttaacaagcattgcagagcctggctcgtgctgcagtgaacaaatgctgacttcagcctttaccctgggtttcaggtcacactgattgtttgcaaaacatgttctttttttgtcacttgccagtacttgttctctgtgagtaaaacacaaacacatcctcagggatgttgcacaccagtttgcagcctgcagcttctgccctctggcctgcccaggtcctcggctccgggacgaggatgctccgggatttcgggagacagcagttgttttgacatgaatctcaaagttcctacaaagcttatttctttgaagaaggccaaaaaaaaaatgaaacattttcagatctttgttttcagattattcaagtccagaatgttggataagatttttgaagaagagatttatgcttgagattccttttagtttctttctttcttttcttttcttttcttttttttttttttttaggtgacttggccagtttgggtttttacggtgttcagggaaagggttaagaagttaatttgggaagtacagtcatgtgttgtacaagttgctgtctactgatcccttcattgagcaagtaaacttcacacattctcgtgtctgcaaagcatgtggatgcatgggcagttatgtgtatgaactttttttttttttgagaatggctttagtgttcagaccaaggatggaatgaaagatcacgtgtgctttccactgtagagctgccctgcttgttttgattttatagttattctaagtgttaagttccttcatctttcaaagcaaattcctttgatccctgaaaatcagctaatgtttgggaggcaattaaaagatgaggctgtggggttggggtgaaggcttccccagcaggaagagaggagaagcccactggatctgggagcacggtgctaggactctctaagcgtgacctccttcagtttggcccagagtggtcagatagtttgccggggcataggatggatgacaggcctcatacgcatcacgtctgaagggaaagcccttgaattttccacgctactttttagtaacagtaggctttgtcataattggcttcatgttccagctttcctaaaactgtaagtgatgttgggtgggccagcagcaaaataattcactttacaatttgcatgatagtctggaatgaaccgaatacctaaaaccaggaaataatagtagatatttaatggtttggggatcaaataagaatttactcccagatgtttcctaattaattggaaaaagcagaaggttgctggaaggccatctccattgggcatttacaggtgaaattcactcttcaactaggattttactcatgggatgcctgtgttcttcatttgaacccaattttacctatcatctacaaaaaaagaaaactattaagagttaaaaaaaaaaaaagagagagagagtcttgaactttgaaatccttcatccacgttttataaagtgtggggtcagattttttccctagttgaaattgaggaaatgagagttgccaatatgattggatttgtactgccaagatggggttttagcacttctaatgcattctggcaaggctggtatacttgtatcaagtgcacagccccactaccaccacctctaccacccacaaaaataaaaactagcaaaataaaatatgagccaacagaattctgtgggaatggcaagtgttttgtttttgtttttagtagtaatctttgcgagaacattccaaagatgatagttttacatttgtatgtttttttccgaggcacttttgaatcatcagatagattaaatataagttccatgtatttttgaaggtgggagtgttctttggtacagttcccccaaaaaactggttctcatgaggcttatgtggtaattctgttaacgagaatgtatgattatctgggatactctgttctgctctccatcctggataagagtttactttgaaagtctagttgatcttttgtgatttctgcacaatgtaaaaggtactttaacttcaggagatagggccagcaatcagatttgatgatggaaaagagtagtgtagcatttaagcataatgtatactctataataaatgtttacaagtccaaaagtgtgccatcagaaagtaaccagatcaaaggagaggtgaccagagaagctggaaagataagaaataaacaagtttcaaggttactgatctgtagctgttgctgtccatgcttcttggcagctttaattatgacagggagagggacccagagggagagagagagactgacttacacataaaggcattttatcacaaagccatctaaaacaaaagtgttaaaggcacaatgctgtgtttaaaaagcatgtacttctttaagagctcaaatttaaatatataatacaaacttaagatccaaggaagaaaatggacccaggacacgaagagaagttaacgccacaggtaatgcagatggccaagagatgtgtgaaaaagataatccagcctcaccaacagccacagaattgaaatgagatacctgtttctgcttctggcattgggaaagaaagaaaaatggcactagcagccttttttttttttttttttttttttccccaaaaaatttgctactcttgaggttctgtcaaagaatgtgctgtggcctctagaagcatttttaaaaagagactttcacaagtgattgtgcaaaattgtgaggtcactgaataggtgtgtatcctcctaaggaggtagcgttggaggagctgttcttgttcaatttactcagcacctgtgaagaggcttcactgtgatttgcctgtacaggtgtgcaggtaaaaatctaagttccacaggtagtgcaaaaaaatctacctccctaggtacctcgtacatttatcacagtttcctggtaaacagttctgctgttgttgacaaaattttatcagaaacattgcatactcttctctaaatagtagtttccctacaagtggctgtcttcagtttagtcgtttaagttatgttgacataaatgattatgtgtgtggcaggggcttttgcgtaggttgttgaaacattgcaccttttggactaacagtttttaccaaaataggcagaagtgacatttgcagccacagctgtgtggcattgagcgtctaaggtatgtgtaataggcagtgtatcggtagcattgataccttggtcaacaccagtaagccatgtaattgcccagaagtgggctctaacactagttttaggagatgcagccaaaacgacaaagctggaggcctctccctctgagcttggcctccacttggtcaaaacagtccccagtttgtccctacgggacacaggcctgccttgttaggaaatcagcaacatttaggagcccacaatacctcacataactctgtgtacagtaacagagaatggaaatagggctgtaagcatgaacaaccagtcaagttacaaatatagaatactctctcaattccactttagttagtcatggagggacagtgtgagttttataaacttataaggaatatacaaacagttccaaatttaaaataacttgaagtaacttttaagtgtgtgaaaagaatatttttttccaccctgtccatttaagcatctgtgacaggcagtattaagtgatgggtgtctttacgtacacatgcctgttgctcacagtactggggaagagttgcaaaatagtcacccattctgcagtgatttctctcttcttatttgtgaaagactcaaaaaaaaaaaaaaaaaaaaaaaaaaaaccaccaccaaaaaaaaggccaggcacggtggctcagacctataatcccagcaccttgggaggccaagtcaggtggatcacaaggtcaggagagcgagaccatcctggctaacacggtgaaaccaaccccgtctctactaaaaatacaaaaaattagctgggcgtggtggtgggcgcctataatcccagctactcgggaagctgaggcaggagaattgcttgaacccgggaggtggaggttgcagtgagccgaaattgtgccattgcactctagcctgggcgccagagcaagactctgactcaaagaaaaaaaaaataggggggatgtgggttgtgagagcgacactgtgtgtccatgcgtgaagaaacccggctcatgatgacctcgccccagaacgccgaagcagggccggtccagcctggatttcacagtgttcttcattgcctttgtccttgattttttgtcgttaccattataacttatctctctttcccaaatgtataagtaggctttgaatatgagtttaaaagaaagaattcggggatgatttcagagtacactagaatattttttaaaagaatattttataaaaatacagtgatagtaaaagaagtagaaggccaaattccgcccccagccccttcttaatattggactttattcctttgcttttttcccttgctgccatctaaggaggctttctgtgctatagcatccagttcctctgccaggcatttctgtaaagatgaggcaccttccactgttttattctccatcattagagcacgtgtcctgctgactcggagcagaggggaggcacacgggggtgaacattccctgacagattggatgtctcttaactcttttttcctggtatcaaagaatggcacaatttagttgatttgatagcgttaccaaatcgtttttcctttagaatgaatctagaatgcagatagattctgaggtccagatgggcctctctccaccaacctgtgaccagtgtacctgtgattttatcactgcacattcatagaaaggttacagggctaatcttcccgtgatatgaatcatgaaagtcaaaatttatgaatgaaaataaaaaggaatgaagtactgatatatgccacaccagagataaatattgaaaacattacctatgctaagtaaaagaagccagtcacaaaagacactacctattgtctgattccattcatgtaaaatatccagaataggcaaatctatagcgacgaaaagtgtaatagtgattgcctgggaaaggggcgtgggaagcatggctaacgggtattgggtttttctttggggtgatgaaaatattgttaagattaattgtggtggtgtttgtacaactctctaaatatactaaaagctaccaaattgtacactctaaatgggtgagttatagggtatgtgaattagatctcaataaagctattgtaaaaaatgtgtgaaggaaggggaagcatcctataacctataccatcccaacagcccagctagaggacgattcctgagcctccttctcagcctttgtgttaattctttgcattgatgacttctctctctttacccttactaattagctctcaaaacctctatttaataatgatgctatttataactttcctccttctggtttcttgcttgccctttttgtggtgtttgcttgtttttcttttttctcaatactctgcccagcgttgcgtgttggttccggagacttaagtgatccagtgggcactgtcaggcaattatttcttttgctcattaattaagtgttcacagatacattcagcagccaaaccttgtggcatgccttctgtcccagacagtgagaatctacttggaacttggatatttctgtgagccttgattatatacaccaccaaggggatggcatagaactaagttttttcttcttctccacaacagactttgttctttaatttcacaagcttgacatagcctataagacatcatagtggtaccatagacagttttcccttgatgcccatgggggatttgttctgggacctcccacagataccaaaatccacaggtttatcagcaagggtcactgctcaattgcaacaactgaagcagaagctcctctcatcagaggcagttactgcagcatgttctgtagggcaaatataaccatatgtaagtgactgtgctatcaggagacagaacaacaagacccagaaagactcagtgacccacagagccagttccacccaaacaagtcttactaatgagattagataatgagagtgtattttcttcatcaattcatgtagctcagcaaggctggaaactgcttgcacacttctgcagagaaaaaaaaaagttccatttgctggaactcaataaataaagaaggccttagtgggtacgtgttatctccttagcatcacctggatgcctgacccttttccagagtgtcatgttgcctgggttttgtccttcagtctaagtgatacacctcttagtgtggcggagaaaagggtgctgtatttcttcctgatggatacatgcttaaatggaaaagtagcatgagatgaactcccatagccccttccttttattatttttaaaatattcattcatttatttatttatttttgagatggagtctcactctgtcacccaggctggagcgcagtggcgcgatctcagctcactgcaacctccgcctcccgggttcaagcaattctcctgcctcggcctcccgagtagctaggactacaggtgtgcccaccaccacacctagctaatttttgtatttttagtagagatcggctttcaccatgttgaccaggctggtcttgaactcttgacctcaggtgatccacccgtctcggccttccaaagtgctgggattacaggcgtgagccactgtgcctggccggcccttccttttagacaatagaaacatgctgcaaccacataccaccataaacacggtgggggaagaggctgcaatcaacagtcaggaggatctgggttccaagcccaggtttgcagtgtaacagctgtgtgctcttggtgtgaacatttggtcatgtacaaatgaggataatgatactgcccccttgtgatcattagggggattaaattaaatgcagaaatatatgtgagatgcttaatgtgttgtaaggcgcatggaatatatttagtgaatattaactgtatattaatacaaagtcctgtattcagaatctccagtataaattacatttatatagtagagatatgaatagtttttgtgaacaagaagacctggaacttcaggtgactagaagctcagagtgagccagctatgtttgatgatagttattcttaagatcacacagagaaacggcaagcaagctgctttgggcaaaaaagagcatttctacactgttcagactgcctctgtactgttagaataggtctagggcgtgttgcgtgagtggtgactgagtaagatgttcagagggaagccgtgaccgtcatcttggaatattgtttgaaagtctgacctgtacaaagcagcactcacttcccctgcgtgtcagacacctgcatgagggctggggagggtccagtacaggaaagcgcatttttaatatgtgtatggaggaagttcgtcaagatgggtgccatctggcagtggagtagcacttcctggaaagtaatgagctcccttggactttgtttgaagagtcacccaggtttttgtaaagaagtgtttcagatcagtatgcaatggatgactgtaaatttctcttcagatctaagaatctgtgattggatgaaagggagaaaggactgcataagtgcttgttgcttgtaaactgggccaggtggatgtcatggccctaggagcttcttgcctgcctttgcatgccataaagcagtcctgcaacccagtgtcacctcagagggatgggaatgtagaagaagagagtgaatagggacagtgatgaggggtgaaaatatgtaactccttgccccttctgtataccctagtacattaggaagttcacccttgtctaggcttcctgttaggaagacagcagactcaaaatggagtctcaacccctttcaaagactgcaagatctccttgtacacactggacttgggagaaaatgagagctttcaggcctgctatcttaacaggttcagaaaggtgtggtccagccccctgactaaccagccctgctgtgcacactgagaattctgctcaggtgtacctttctgtgtgctcctgggtgcacccccaaagtgctggttctcttgaaaacctttttatttaggttcagacagacaaactgtggtatcttccattctgaccataaagtgtttcttctgggtctaactactatagtgggatattttctctagaacaagaggttgtttctttttggcattgagaaatgttgccgatgtgattttcttttgtgaacgtttaagacacagcgcttgccacttgaactttcttttgccgtgcgtagctgattccacataatggctgcagctccaggcagaaacctgtttggaagttgttttaaactcttcctggaatctctaggcagtggctcagtggggtttttttccaaccattccttaggatgaccagaagcttgacagaatcctcttgtcttcattttgagaaaatatgtctttactgtgtgtatgtgcagcatttggttttacctcgtgggtctaagcattttcaactaagcttccttttccaacctagcagacttgtttaaagaacttcaaactaatagccaagctgtaatacggtggctctctcagcctgagaagcctgtgctcaccgtcactctcttcttccctggggtgatagggatggggagtagtgtgtgtgagaggacagaagcgaggattgattgaagattattttacgaggcgagagcatggtggcacacctgtcagctgagtggactcagcgcctgccccggctaggctgtcctcctcctgtgccagccgtgggttccctgagtccctctgcagtcattcatgggtgctgaaaataaagataccctttctgtcgaaagtgttcgccgggctgcctctgcctccctggaaaagcagcagggcacacaggcttcctaggcagcccctgagggaggggctctttttattgtcactctggttagtttgaagaccagacagaaggcagcaaaaaccaaccctttgttgaaaactctttgcctttaggcccttggtaccatgttcatgaggctccagataattccacaaatacattattattgttacctagacttggggacagagaagggtgaaacatgggtctgggaattcacagatgaatatactgtaatcccctcgagcacatttcttttaaaggaatgggggtattctaaaggagtgaacactccactggggggctgctaggcccctgtgaacggtggcagccttggccacggtgtgtgctgtgatctctcctgggtcccccgggcatcctcagacctcccccacacccaacccacagtcccttctccatccatctgctgaccacaccccaggatgtttccagctcagatcacgcctgattgcatccacacaaactgcacgccaggcatttccgtttggatgtgtacacaaaaacaacacgtcccagactgagctgatctttctgtacccctcaaaagaaaagttctgtacccggccaggcctggtggctcacacctgtaatcccagcactttgggaggccaaggcaggaggatcacgaggtcaggagattgagaccatcctgggtaacacggtgaaaccctgtctctgctaaaaatacaaaaaattagctgggcatggtggcgggcgcctgtagtcccagctacaggagaatggcaagaatccggaaggcaaagctggagcttgcagtgagctgagattgagccactgcactccagcctggtgacagagtgacactccgtctcaaaaaaaaaaaaaaaaaaaaagaaattctgtacccttccagatggtcctggacatatcttgaatctaccctgcttttcctcatctgcactgctgtcctcttgatctgggctactgaggctagaatgcacatctgatcatgtgcctcctgcttaaaatagtatttttcctcttaagagtagtccaaactcctattgctggattaaaaggctgttccaggctctccctacctcagggcacaccatctttcctcccagtctcccctcccctctgtctccagtgcttccatccttcagtcatgctgaggttgtctttgttacctttgcttctcttggcccgcactctctgttggctctgccagcatccctatgcacctgctagctcctactcacttgtccagctttggcctggaagtcccttcccctggcaggcagccctaagctaccctttgcttgctactggctcatattctcactgcttgtcctcaggctgtgagccctgggagggctgggctgagtccccgaacctgccacgtctatagggtgtaacctacctgaggcctgactgctaaaatcaaaagaagcctttctcatttgcttagctgagctaagtcctttctggagaagaatgcccacgtcctgggtggacttctgttcggcctggggcaggacgctgcatgtcagttcacctagagcccctcgcttgccctcacccctctccctttccttctcctccccgtgttgtctcatggtcagttcctctcctggcaaggcaagagaatcataaaatctctttggaccatgtgtctctctgatgcactttggaggttgaagctcactttcgtgaagttaggagcggttaatcctcctgcacgaggatgcatgcctgctagggaaagcctccctgcgtttatatggaacagtggtgtgtaccttagggcaacccagaaacagctgagatggccctaaactcttccgtattttgattcagaagctttaccttatttgaacatctgcagaataagttctttcctttagaaatgattggggataaaattgtttgcattatgaaatattgtatggccaggtggcccctctttcatgttttgttccttgtgaagaggttgagtctcctattttttttttttttttggagatagagttttgttcttgtccctcaggctggagtaaaatggtgcaatcttggctcactgcaacctccgcctcctgggttcaaacgattctcctgcctcagcctcccaagtagctgggatcacaggcacgtgccaccacacctggctaatttttgtatttttagtaagagatggggtttcgccatgttgggcaggctggtcttgaactcctgacctcagttgatctgcccgcctcggcctcccaaagtgctgggatcacaggcgtgagccaccacgcccagcctatggtatgcttttaaaaatggtttctctgcactaatgattatttaaaaaaaaaactctggcaagaacaaaaacaaatggttttttaaaaactctagaaataatttgatacattcgaggactctggagagggagagagttaaaggctgatgtgtgtgactctttttcctctccccccaaggaaaaaaaatgaagagaaggagcttttaagtgcagtgcctcgtttttatgtgattgcaaacctgaaccaatccttttagtggtggatgtgggacatgttagcttttccaacagtttagatgggcctttgtttttattgttggtcactgtaagaattccaaggaatagaaggatctcatgggcaaaatcagtttgcttttttctctgtatatttgttagtttatagcagcttctattttcctcctatttttaaaagctgaaatgcctttaatcgcactcagtgtgtttattcatggaagccagagaagagggtcccttcctttcccccatagcgccgtaattggaaatttggtagtactaggtgaaattctcagttttggcgctcgcatggaacagccatccatctgctggcgagacacactgcccggggcttttcaagaaatcccttaatggtcctgaacactaataatatttatatacattgagatgagacaaaatttacagcgggctctggggctggctccaggactctctaatcccacacttgctcacgttctcttgcttgcctcctagaatcctttcaggttgtgcttcagtgaggggagcatggtgtccgtctctgcagcaatgcttatttatgcagttcgtcctctaacaaacagagcaactttccttttgaccttcccctcttctccccatcacattccattgctgcccccgcatagagcatgtgcttatgcatagtttgcatcatttaacacgaaggaaccccttgatttgtgatccctttaagaagttgctctgtatataaagaaaatgatttttcctggttggttttactgaagttccttcagaaatagctcccaccaccgaaacacacctgacttccccagcctgtgtatcggttgtggcacggactgactgactggatggtataatttcactcactcctttgggaagtttcgggggactactgctcagatgtgtgggaaatgcggaatatatctacaggtactttgtcagtttttttttttcttttctttctcatcctggaaaatcccggcattgatatttaggtataactatttgcaagcaagtgcagagggacatttttctgttcttttcaacgttcttattactactgcattaatagctacttgatcttaatgtctattacacatcattttatataatgttttctttaaattgtcagggaaagggattctgcaagtagatgttggtccccccagttagtgtctgatgatgatggtaagattctcagagtttccttcctctaatgacaaagcatggtgatggtgatgtctgaagagcagcctcggtgctccaagatgggtgtatgcttaatactgctggcacacgcctgacgagcgggaatgtgagcgttgtttctgtaaccagttttactgaacctcacagatccattatacgacgtgaattttgtgggaataacataggctgggagtctgctctcttccagcctggtccctctcttctttcagccctaccctctctgatcatcatgtcccttgcactgcggccaggtaacctttctgatacgaaggtctgggcatgttgttcccttgcctaaaactttccatggtttcgtattatccacagttgggctaaaccctctgggacaggccttcagtgcctccccgggcagtggtccctggccttcttcagtaacacccaagcccttgcacccacagtgacctcgttgcttttacaagcatttacatgtgatgttctttattcctcccttgctcatctttccactttcaactccacaaaaccgtcctcggcacccagaagcccaggaaacaccaggcagctccactcactcccgtacttgctgtgtcgtccgttccctggggacaggattgtcgctgatcctgcgtgcatctgtctggcacacaggtgcagcacacattaaatagctgctaaatgaataaatgaagaatagatggaattatattctgttgtgaccagtttaaaaacatgaaattggaatacccaattgcagtgtttctttagatcttggaccttgaggtgacctctgtaatggatatatttgaaattattaactgtcttcaagtgggggtttgatgagagagagagagagagtgtgtgtgtgtgtgtgtgtgtgtgtgtgtgtttacagaaaatatgctaggtttgtacattcaaatttgtgttatcctcttcaagaaagtcaccttggtagacagcatatatatcccaacattttaggaactcataaaatgcatacttttttggtgtgatcagagatgggtaactccttattacttgtgggttagattagtttttggaaatagcctggagtcattgagagccaatccttatcaacaaaatggcataaatggacaggaatgggtttcttcttcactttagagatagctctgaagacatgtctcagttgggattagttcagttgcatatatgaatagcagtcattgaaacaagataaaagtgtatgtctctcacatctaaagaagtctggagtaagcagtccagggttagcctagcggccccactctcataagggactaagttccttttatctcgcttcaccattcttgatgtttcgccttgtggtccaaggttggtacttgagctccaagcattactactgcattccagccagcaaggaggaggatggccatgccctctttgttctcaggagtcttccaggaagttccagtcacaacgtttgtttatatctcactggccagaacttaagtcatatggccacctctagctacaaggaaggctgggagatgtagtctgtaactggatggccatattatcaactaaaaattactgaaaatgacaagaagaataaataatggaaggcaacctgttgtttctgtcaaaggatgacttcaaaagagaaagttgcaaaagtatttcaagcttgacagtatcatgacagttttcttcagaggtgacgctattcatttgcatgtccaagttctgatatctgttttcaagttcacctatttgcagcgaaataggaactcttggaggcaactagtgggtgtgtaaaccggtacaaactttctagaggacagtttaacccaacaagatgaattctggaaattgatcctaatgaaatgttaagggtgctcatgaagattgctttgccgattgcaataataaaaagtaaagaaaatatcttataattggggacaggtgtaacttatgatacattccacaatggagtgtaatactgctgttaaatgtttgtggaattcacaatcttttatgccaaaagaaagctttcagaatggcttgtcttttttgtagatacttgtatttatatgtccatgcacatacataagaaaggaccagggaaggtctgcttgaagatattaataaaggggtcacttgtgggtaggtggacttacttgttctctatattctctttacttgtttgtgatctctggtttttttaatcatgtatttttattacaagaaaaaacaaattctagaatctccactcaatattgcatgtcagagtcaaaaagatacacatttaaataattttgtattgttttccaatttgaggataaagtaggaaatgtataatgcaaaccagatttcatattttgttgatttagacttaatttacaagtaaggctgacagcccacagagtgtgatcacgacagcattgttatggaaataaatgccagctcatgcatttgggatgtacaccatggatctgtggttattagatactgatttcactttagcacacgaagaggcttagcggaggtggcttctaatatcctatggttctgtgggctcggagatgctactcacccacttgtcagaggcattgaaaccagagcaactgcatcttgaataggagctaggtaaaatgaggccgaattcccagacagttaagacattctgagtcacaggatgaggttaaaggtcagcacaaaatacaggtcataaagaccttgctgatctagcagatgcagttaaagaagccggcgcaaacccaccaaaaccaagatggtaacgagagtgacctgtgatcgtcctcactgctgcactcccaccagcgccatgagtgtttacatgtcatagcaacatcaggaagttaccctatatggtctaaaatggagaggtatgaataatccaccccttgtttagcgtgtcataaaaatgggcaaccagcagccttccaggctgctctgtgtatggagtagccattcttctgttcctttactttcctaatcagcttgctttcagtttacagactcaccctgaattattcttgcgtaagatctaagaaccctctcttggggtctggatcaggactcctttcctgtaacacacctatgttcttggacttaagaatgaccctcagacatggtgacttctttgtcatctaacagctttggcttatttgaggtaaaacctttgatatctaaggcagcagaaatttccctgaagtcattttgaatggtatcatctttactatagtgtagtttaatcattttcaaagtaagcatttctgcacactaaggctttaaaagagttttcagtaaggaacatatttgaaatggaaagtgagcagagcacaatgccttttaaattactgataaaccatagagttcctgtagggcttccactggctgacccacgcctgaggcaaccctcaaatgtgggtattatccccctcattttacagatgggaagagagaggatcaagatcacagaagctaatggtttgtcccagaccaaacaaggagttcctaggagagactgaactttaaagatatcgactctctgcaggtctaagtggatgaaaggacagtggtgggggtgaggatttcgtagtgtgtttttgcattgtctcctcaatgagtgatctggtgctggtggtagcagtgaatgacccagaaggatgctggccaggcccagagaaggcggtgcctcccctgcccggtctcatctccgtctctcctctctctccacagtgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagaggtcagtcgcggccacacgtgtggtcactacccgccccacctcacccgccaccctagcacacaaaggtagactctgtcggttgtttcatccgggtgcagccctcaggaagttcactgaggtgggtcattttgagagggctggcttaccttaaatgtttggtgagattctaggaacaattggcatggcttaccgcccccctcaccagtttgttttatattttaagtgcatactgcctggccatttgaaattaagtacttgcttgctggtttcgatacccagagttcatagtctctctgggtacttgccaagctgccatctaagagacagggaactgtagttttggattttcctagtctgggtgctgctagccaggtgaggctttggaagtgcaaaagaaaagacatgctaagcccccaccaccatccttgagaccagcaagcggacctaaacatcttagtgcaagagctagcagcagctcagagtaggcagtagcttaaaataagggacatttttccatcagcacttccttcctctcatccccctctaccttgaccctccctcagtgctcatcatgtccttcattttccttcctgaactttgagacttcacttgggaagcaaagaagttccttatggccaggcatgtggctcacacctgtaatcccaatactttgggaggctgaggtgcttggatcacttgaggtcagagtttgagaccagcctggccaacgtgatgaaaccctgtctctactaaaaatacaaaaattagcacctgtagtcctagctactccgaggcaggagaattgcttgaacctgggaggcagaggttgcagtgagccaagatcacactacttcattccatcctgggagacagagtctcactctgtctccaaaaaaaaaaaaaaaaaagagaagttcgttataacaaatgccatatgcccttttgtacatgtcaactggacttctataaatttgtcattggtttatgcttttgaaaataagatgttagcattgtttaaaaatgtgataactataactttgaaagcaaaagaagattggagatttggggttgctgttccctttcctggagcagagtaaagaacttttaggggctcacgcctgtaatcccaacactttgggaggccaaggtgggcagatcccttgaggccatgggttcaagaccagcctgggcaacatgcaaaccccatctgtacaaaagattaaaaaaaaattagtttggcgtggtggcacacacctgtagtctcagctccttgggagttgcaagtgggaggatcacctgagcccttgaggtcaaggccgaaataagccaaaatcgcctcactgcactccagcacaggcaacagagaccctgtctcaaaaaaaagaacttttaggaaagttctgttttagtggactaaatgcctccttcatgattagcaccagggggcctgtctttctgagtctgtcaaaatctattctacaaatataaaaatatcgttagaaaagtaggtgttaattttaaatataatttttgctgcagcttatgaagtacattgaggaagtgtttataaaggggattctttttctagtgtattatttggagacgcagcttctactgtaggcttaccttcaaatcaaagataatacattcttttatagtattagatgtagagcaactttctccctcttataatctgtataaccattagcatactaacaacaagaagaaaattactctgaatactttaaaatgataaataggccaaggacttcaatgagctgtagaggatacatattacatccaaaatcagtctaccacattgtactcacattttgttggcagccttcgagtgtaaaagggcttttactggtgcacacctcgggcccaggggcagtgcctggaaccaagttgaggctcagacactattcagacgtcaccttcctccttggggtggggttaggggagtggtagcttgtccatgaactcagtgtgctatcgtctttgttttgtgaatacattttcttaatgacatttggaggccttcagtcgttctgcagccaccagagttgtggcaaagtgggaatgctgtccatttgacagtgttgtttcttccgctctagtgcactcttcagagaattgagccattatttcccctattcattcttacagtccgttaaaaactatacatctacctttttgtttaaaaataaaacaccataaagaataataaattcccttctctcagcctttgaggcttatttaacaattactttgaaatatttaattttttcatcttgtttataccttctctataccatagtggatttgaggaagcttaatctataaacatgttatcaaaacacttccttagaaaaacattttttaagtgcttgatgactcctagactttttaccaaagatgattggttccattttttttttcttttcttttctctttgatagactctggctgtgtcacccaggctggagtgcagtggcacaatcatagctcactgcagcctcaaactcctgggctcaagtgatcctcctgcctcagcctcccaaagtgctgggattacagatgtgagccactgtacccagcttcagatttttctatttgagtgaaagatggagagaaactaaacatacacttatggtacaacccagcagttgtaaccctggatatttatcacagagaaatgaaatttatgtcaacacaaaaatatgtacaccatcgtccatagcagctttatttgtaataaccccaaattggaaattactcagatgtcctatgatagatagttagttaaactgtgggacatccacaccatggaatattattactcagcaataaaaaggaacaaaccattgaagtacactacttggatggatctcaaggacattatgctctgtgaaaaagccaacctcaaaagatcacatactgtataattccatttatgcaacatcctcaaaatgacagattatagccaggcacggcggctcacgcctgtgatcccagcaatttgggaggctgaggtgggtggatcacctgaggtcaagagtttgagaccagcctggccaacatggtgaaaccgtgtctctactaaaattacaaagtttggccagtcacagtggctcatacctatctcagcaccttgggaggctgaggcaggcagattgcttgaggtcaggaggccaacatggtgaaaccccatctctactaaaaatacaaaaattagccgggcctggtgatgggtgcctgtatttccagctactcaggaggctgaggcaggagaatcacttgaacccaggaggtggaggttgcagtgagctgagatcatgccgctgcactgtagcctgggcgacagagtgagaccctgtctcaaaaaaaaaaaaaaagacagattgtagacatggaaaacagattagtggttgccaggtgttagggacattggggactaggttgggcagggcagtgagtatgaacaggtggcattagggagagcttggtggtgacggaacagttctgtatcttgattgtagttgtgattacacaaatctacacaagtgatcagtgacacagcaccacacacacacacacacacacacacacacacacacacacacacacagagttaatttcccaggtttgatacttatatcatgtaagatgtagtaaacattggaggaagttggatgaaggctatgtgggatctctctgtaactttctcgtaaatctttgcagctttttgtgactctataattattttaaaataaaatttttttttttaaatggaaagtttatagggtatgtagataaattagaaacaacagaaggccaagtaaaaaagtgctgaaggaagcctctacccaggctggaaatgagaatgttgaatgcaatggtagaggaaggactctccccatctgtgggtgggtccagttcctgtaggacccttggggaagccatgacccccattctcccaaacacacaataggaaaataccagagaagttttgtttacctgttagcttttaaacaaaacagaaccctgcatctttgtcttagatacaaaataaccttcatgggtagggggaagggacattaataaaaagagctataatttacattgtttttcttgaatgtttttacttcacgaaatttgagagatgatttaagaacaataatgtacatataatggctccccagcttaccatcctattacacacacatcgcataagttcgtattatttgtcttgtttggaaatcagtccaactttctgacccttgttctatatataactatagatcccaaaggttcagctgctgggctagcattttgtctgctatttcctaaataatggtaggtaagcaggaaaagtgccagtcttacttgtccctgactcttggtggttcgtggcatgttcaggatagtatttgaaacaagagctcattacaaagtaatggaaaccccttgcttttattgtgtatgcagcaaaagcaacatttggatcaatttacaagtttctgcaaaacaccgtcaagaaataatttcggttgtgctttagcaagaaaataatggatctgtgctataccacatgccttttggtatccctcactgggctttgccaaaacactgactgcaggagctagactactgttaggcagagacactgcactccctttgctgtccctgccttctctcctagcgactcctccaggtacacaggccagggtcacagtatcagaaagcagctctgttttcctccagaaccccccaagcttcctttctgcagcactgtctctcccacatggaaccagctggctcaccagtcaacagcctatgacacacaaatgccttgaggatgcagcatgtattttgtctggaagcaagcaacacgctcttcctttgtaggctgtttctccttttgcttgcaatgtgagtggcttatcttgggtgggcttgggggtgagataccatgtgaccacatgaacacttcaaaacagttgctttttctaatgcatgctgtaataacaatgaaaagcatatccttatggtttttttaatgcaagaagacagactcaattatgtgtgtttttgattttttttttcttcttcaacagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggagtaagtattccatccccctggaaaaacggctagatctcatggttttcttttgttgatgcttttcatgctcccgtccctgagtcaccactaaaatatgggcttagataaacaacatggtgtgtaagcctcacgcatgacgtctcttctttgagtttccctgaaagataaagaacagattgaaaggcaatctgtcttttagccattggcacgtcatttattcctgtaaagagggtcatcgctcatctttttgttagtcacatcttgcataggagaggcaagccctgacacatacaaaccccagaagagaccattggatcagacgtgtgactcagcagactccagctgtagccaaatccacacatctttcaagtctaaagagttttggttacttgaatttactgagaagactgagcaaagggaagtttagtgatatcacgttaaaattttatgaagtccaaaagaatgctagatttccaaatttacttgtgagagacaaaaggatacaagtgtgtgtcattgtgtacataaagtttcggtctcacccctgtacaatgacctttatttgcaatagatggcattcctggtaagttgcttctgagttggatttgtgcaaaggatttcccactgacttagcctatgatctcttcacttctttggttttttgtgtgtttgttttttggttttgttttgagacagggtctcactgtatcacccaggctggagtgcaatggcataatcatagctcactgtaacctggaactcctagtctcaaacaatccttctgctcagcctcccacgttgctgggaccacaggcacacactaccatgtctggataattttaaaaatcttttcacttctgatttttcattgccaagggcttctagtaatggtgccttaaattctctgccactgggaccacttggtcaaggtactgatagttttataagctagaataaatatcgtaaaatggctttgaagttgaaaggaattttggggggggaatccttttatgaagaatttttttttttttttacagtttgagaggaaaaataatgtattttgagaatgtgttttccttaatatttgttaaatgagtagactgtattcttaaggtttagaaaggacagaaacaagtttgtgcttagttcttctgaattcgttgatatcccttgttgctgttcacaatacacccactcccagccctccgtgatggagataactctgttccccacaactagggcttgcccactctcatggtacttctgatgtttaattcttttggctgtgtctgcatttcctcatttacttttaatttgcttatccctagaacataccttttgagtgcctaaacttttttatcttcctgtcctgaagacaaaaatttaatctgtgaattaaacccatggagaagtatcatttatgaagggattggtacatattgatgcatgatgatgaaatgtgtcttctggtttatgtccattgcaggaaatagattggatttaggatgatgggacatctcattagaggggaaatttcctgatcttgactaaggcatgcttcctgccccacgtttaaaattcaggatctcttccttaaaacatcaactgcacgcaacctctcatctttccaacttgaacttccctttaatttttcttggaaagctattaaattaaattagatgtagggctttatcctttagtacccttattattttatttgtatcaactcaaagcaaaatagagcattttattaaatatgtcttcataaattacgcacagtaaaatcccattaattggaccacacccagttcattatagtgtttattataattttagcattagttgaactgaaaattggtttttgtttactatgagaaaaaggtagactaaacaagatgaaacctgttgtttgcatattatgtttgtacatctttattagcaactatttttccaactattttcaactatttttccaactattttctagttataaaagcaatacataaatactatagaaaatttagcaatgcagaaatgaatttttaaaaatccctcatagatagccattgttaacattttggtgtattttcttcaagtcttagtaaaatggaacctttaaatatagatccctgtatcttaggaattagaaaggcagcaaaggcagttcctaatgagatggagaaaatgttgatttagtcatgcccttgtactgtgggggccatactgtctgttgacagagcatattaaaagacgttccctacattcgtcagccttagctaattggcagtctggtatttatgattttatattttgttaatcagcttgggagctgcagtaccccccagcctcctagaaacttggcttcccctgcctgggaggcctcgttccaggagtcgttgttgagagtcaagccagggaagtgtgtttttgtcagggagcagccagtcctgtgctgggagcatctcagggggcacctgccgttgaattgttctcacttgtgtttgtaagaatccaagtatgtcacccttacaccaagtgagcacacagtgacacaatcccctttcaatgtagataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggtaagtgccccaaatttcatgagctgacgttctattacaaaataagcagcgtgcttatgaaactgtgttgctgaggtaagagccctccctgccttgttaaagagaagaaaggaggaagccgcagtattgcctgtgctgctcgagtaggtcttgggtggagtcatggttctccattcttaggaggttgctgtttggaaaacagagatgttatcacccttactggattttgcctcatcagtcaagggttgcgtgtctgactgtgaccagtgagacggcagacgggggtgcgcttagggcttttctgccaagaatgacagcagttggtctggagtgctcacctccctgtgaaatcattgttcgcgcgaccctcatctgcctcaggatgctgtactctactacgcacaactgctccatcttttaagatattggaagtgagagcacgggaggagcatgggcggttcgttttgttagaaagaaacccggattcacgagatggtttttattgattagtttacaggatttgcactattgatagagtttttgccttggcacaggcctgctttgtgataggggttttaaaataaccgtgggcttttcactggaggataaaagccggtgcttattgcatgcacaattgctttccagccgtcagcctgtgtgtacctttgcatatgtacttttctctttaaactctcccttttaaatacgactcttgccaggctttaagtgaatgcttcaaaataaaaggagttatcaattaaagagtgaattccttccaaagagaatttgggaaaataatttaggaaaagaagaggcgagaaggtcatgggaaaggttgtctttgctgatttatctgccccaactggataaagttactgcataagggtttctttacagcctccctgtttttctcagactaactcttggtcagtcttaaattcttaaaattccatcatctgatagagctaacgagagcgggcagctcttcattccatccttgaaaagcacagtgtcctccccactggggaacaccaatccttaaaaaacttctttctcattgcaaatcgaaggaggctgccgctgcacccagccccagactcctcagtcacttacctggcaagctgaggccctaccagtttaaggtgatgattattgtttcttgtattaaattttaaaatgaatttttctccgctttttttttttctaagtaggtttgtgtttctggaatctcgggtgtctgtgagcatttcttcttcagcagagcagtagctgtcaaattttcttgttgcttaatgatatacttttttgtttctagactaagcaaatgatagacatagaggtgaatgctgagaggagagtttaattaatttccattaggaattattatgtggttaccttttcatggagtgttaactaagtattgtgcacttaaatgtagttagaaattaaagcctgatttttatttgcaagaatatttatgatgtctttctcattatctgaaacttgcataaaacctgaagcatcagcaaaatctttttaaggttgcgtgctcaggtgtttgggaggctttccaggtaagcccgggcccctggcctgctcttaccattttagatgcaggggagggcaagtgggccttgggttttccctgctgctgctgctccccagtagtcctgcagctccaaggatgctggctccagcctttcattcctgcgtgcagcttctaagaggctctttcttgagcttgggctcttaagaatcttttacctcccgatgggaagttttctctcaccctgtcttcctggcccatgaccacaaaggtatagcccatcctcacgatgatgagctccccaagagctctgtttgcttcaggtgttgagaccgctagcaacacctcagctgttcatttctccttagactcagggacagagttaggtctggccccttcactagctgccctcacttctgcaagaagggaagagtcagagcgagaaagagaaggacaggatacgatagtcagataaacatcagcagtgcaaagcagaactcgcacagtgatacaagggaaagaaagaaatgtgccctaggcatggagaagagccagatacctgagaagatcagacaggcttctgacaagaggtggcatttgagatgggccttgaaggctttcgggaaaaacttgaggaaagcagaggattgaagtgaagaaaggcaattcaaggtagggtggcaggagcaaaggcaacgagttggggcatcctggggcctgttgggcaactaacactggagaggtgggtggtactagagttatgtaagatgttttgcacgcaggtataaagggttataatttaggaagaccatggaacgtattcaaggcttttgaatagaggagtgttagcagagctgtctgaaatttttatttcggtgtgcttttggtttaagccaagatagctttcatcccagtgtttctcaaactttgctacacattatggaatcattgggggtgggggcaggggtggagttgagaaatcctgatgtccaagttgcacccccaccccaattcaataggagcgtttggggttaggatccaggaatcagtgcttgtctaaagatccctaggctcttcagcaggcagcaaagattggaaaccactgctttatcccttcatttcttcccatgtgcatatcacaaagcactttgacggttttttttcctaaatattttcccctcacactgctgcctaatgttttagaggttcacccatgttgttaacacgtgtcacactattttcttgaacttttttttttttttttttttgagatggaatcttgctgtgtcgcccaggctggagtgtagtggcgctgtctcggctcactgcaccctctgcctcctgggttcaagcgattctcctgcctcagcctcctgaatagctgggattactggcacgcaccaccacgcccggcttatttttgcttttagtagagacggactttcaccgtgttgttcaggctggtctcaaactcctgaccttgtgatccgcccgcctcagcctcccaatgtgctgggattacaggcttgagccaccacgcccggccttcttgaacttcttttatagccagtgataacataaatgtttccatttggttcaataggatgaaagttctgttctgtagccttttgtttttgatggagaacagaacaattcaaggtacagagatccttcaactctgacaaccttggctttccaaaatgtcactgagatccccctcaaaaagtctcctgagccatccagaacagaaaattcaagcattttacatagagtagagctcttattcctcactcagagcctgttgacttttatatcgcactcggcgtgagctgattttgtaacccagttacaaaagccatagccatggtttcctcaaggacaccatagggtgtatttctagagtaatgaccttagacattaagaaaatcaagaccgctctgctgtttacaaaggaaacaggttttgtaatccacatgtacacaatttttataaaatagctaatttttaagctcttgagtaagagaatattttcactatctggaaaatccccttgtttggacaaccttgtttcctgatggcatcagataaataaggagttaaagtttcacattatttggtgctaccaaggattgttgccttgaaaagaagaaggaaaaagtagatggagggtggtgagttaaaagaattgaaattcgcggataggcatttctatgcttttgttcctaccactcgactgtgcaacacgcagtgctttgtaataccttcttggagctcaaaggtcaggctgaaacatggccgctttttcacatttccctgggacttttggaaaatatacaccaaccctgtgacctagcaattccgggatccacccaagagaaatgaaaacatgcccacacaagacttgtgtatgaatgctggtagcagtattactcataatagcctcccgggattcccccgacccccagcccaaaagaaagacccactggaaaccattcagatgttcatcagcagatgagtggatagaaagataaatggataaatgaaatgtggcacaaaggacaactgactactcaacaataaaaagacgtgaagtatgacacgtgttacaacatgggtgaacctctaaaacattaggctaagtgaaaagaaaaaatccagacacaaaagactacatattatatgactcattcgtatgtaatttgcagaaaaggcaaaactatagagacagaaagcagaccagggatggctgcaaggaagaggtggagattgaccaccaatgggaatgagggaactcttggatgatggaagtgttctggaactgagtagtggtgatggttggacagttgtgtaaatttacggaagctcatggaatgatgggtgaattttttttttttttttttttgagatggagtctcactctgtcacccaggctgcagtgcagtggcgctgtctcggatcactgcaagctccgcctccgggttcacaccattcccctgcctcagcctcccgagtagccgggactacaggcgctcaccaccacgcccgactaatttttttgtatttttagtagagacggggtttcaccatgttagccagtatggtctcgatcatctgacctcgtgatctgcctgcctcggcctctgaaagtgctgggattacaggtgtgagccaccgtgcctggcctgatgggtgaatatttgataggcaggttatacttcagaagtaaagctatttttaagaaacacctaaacaaagaggaaacattgtctgaatatctgtatggtgcctggttccacctagatagacatatccacccttgctgaacccctaaggttgatgtaaatattggatttgggggagagtggacatgatataaaccagcctgtttgcagatggattggtgggagcatctgcagaaaggcaaaaaaggccaaatactcttatcagttgcagatggctctgttgctgatgacagcctgtgtcctgggttctgatgccccctagagacagccgtgaagaggcaattttctcctcgaaggaaggaactggaatgattggttgtataattgcagaattgttttcagtatgtcagcaagcactgaaaatggggaaactgtcccttcctacctctgtaggctggagacctcgggttcagctccatttatcagggcacaggaccttcctgttctgagactttgttccaggggactttcacacttcagagaatagcacatgtcatcctgcacttttgtggggtgattaaaagctcacggtatccttttatgtttagcccatccaattcttccaactggcctcagccagaaaagcagggaaggcacccccagtttgcagctgagagactccagcctgggagagctgaataaatcttttgcccagaggggttcctcagtaaatgctggagatgaggctcagacctgacctttggattcccagatggagtgctctgaaccgtgtacctggggctgtcttcaccactcaaatatcgatagagataacatagagatgtcctcaggaagataaccaactgttcccatcctgtgtggtctacagattgggagatagggcctacccaagtgtagaaataaacattttttacaacatagagaaggctgagaaccaggataccaatatcaataaaatctggatatcatagagcacatggaagctaaagaaaaataagtaactggtcaggtgtggtggctcacacctgtaatcccagcactttggaagaccatggcaaggcattgcttgagcccaggagtttgagaccagccagggcaacatagtgagataccagctgttaaaaaaaaaaaagaaaagaaaaattaaccaagcatggtggggcatacctatggtcccagctacttgggaggctgaggtaggagggtagcttgagcctgggaagttgaggctgcagtgctctgtcattgcaccactgcaccccaacctggattacagagtgagaccctgtctcaaggggaaaaaaaaaaaaaaacctaatttttaaaagcattctttgaatgtaaaggcagtaagctaagaaacaattaggaaatcacatttactgaataatttacttaagtaatctttttcttcaggaaacaatgataactttagcgtatgcatattttaaagatgtgcagacaggtctctgccttttaccttctcttaattctcacctaatcatggaaggaatttagcggggagccttgccccaagctgtggctcgaaaaacaagcatggtattgacaggcagctcatgaatggcttgattattattttgacaagggttttatttttatttttctttagcttccacaggctccataatgcctgggttttattgatattggtatcctggctcccagcctcttcaatgattgtaaaaaatgtttgtgtttactgtaaaaagataatcttgcttttcaaagtgattagtcaaatacacagaatttcagtgtgcctgccattcatttgtcaaattcctggtttataattcatgcttcctcccgtgggggagaagaatgttttgttcagaaggtatttttggtgtggttccgttccctgctagtgaaattagtttatgaaaagaggcctggttctgggtgtagatggaagtttggcctgattaattggtccttaccggcagcccagaggtttcttcatcaacaaggagattttgtcctgtaactaactcaggtacctggaagcagcccgacatttgggggtgcatcgctgcagtctcctttggagctggagaaacctatgagcaagaatgggcttatgacacatccatttccactccatccctccttccgttgtatgactgcatggagcccctctgacctccagcagtgtcacctgcagcctggtagtgagaaacagcaggtatggatggggtctacccccagcaacagtagcgccagctgggccatatcctggcactgctccccaggaaacacaccttgtgttgcattgaccagatctgggatcatttggacaatgtcttatgctgcttttccaggatagctgtgtgttcaggagggagcccttactgaaaggaaagaactgttgacttacaagtttttgctaccggtttggtggtcactaatgtgtccagaggcctgaagatgggcgtgtgaggagcctgacttagcttcagaggctctgtctttcgactcacttgtgtgctcactgcacccctgtgctggcaggactccaacctccacccccagcacttgtgtggacagagagcccagtgctcaggaaagggttgggcttcaggcttgtgatgcagattccgtggtggctctgtgactccttctggtcgttcttaaagtagacagggagcttagatgtcacctgtgcattccccttgttgtcctacgagtgagtaaacagggctacagatagcactaagggatctgcgcatggctgtgcagctcattcatggcatttctggtcctgggtcccagtctctgaactccttcctggtctgacgtccctttgtgaatgttcaggaaaatgtcacagggctgcttggcagcattgtaaccataatttgtgctttactgtaaatgagaatcaggctgaggattgaccagctggttagaggtcctggtttgggtgtaaatgaagaccctcaccagatgcagagagatccccaatggacatagcctccagggcagacgaagccttaggggttctgttttgtcctggctacgctggctctgcagggagggctggggttctttctcctttgtgtgtttatacattagatctgtgagtggatcttagaagtcactcaaagtactgcactgattcccaaacttagtaagaagcagagcaggaagaggagaagaaggattcacggtccatggggatcaggcccatcagcacagaggactcagaagtcaaccctggcattgtctgctgccttcctggggaagccagagagaaaggcccactgcggggatctttctctagacctaagccgtagctgtctgctttcttgcctctccagggatggacttgtcctgccacctgggtagccagatagaacggcttcctgtgctggttggatctgctactcgtgtgcacaccctctggggcagaagccacgtctggtttggtgggctttggtcctccaccacctcactggaactcagcctctcctagattgctggttctccacgtgtggtccagggaccacagcaggggtcagcaccacctgggatttgtgataaatgcagattctttgcccaccccagctgaatcagaagctctgggggtggggcccagccctttgcaaacaagctttgtgcacactgaacttggagaaccactgtgttggactccgagtcctcttgcctggatgagaggcccaagagcactgcatgttagtggctcttcctcctcccccacacctccagggactggagctggggctgctcagaatgaaagatgaatgggggagggagaaggcccagggttgaccccccacaagcttgtctccctgtctcatgctgtctcctatcccatcatgctgctgattgggcaggatttacttccatggataatgggagactttagagcaaagtgtacgctgttccgattgggtagcagagcatgtctgttctctcatggactgctttcaagcacgttgtacatacttggctgagaaaaataaccaaaggcatttcttgggaatgattctagtaacatcctctggtacaagaagcattatttgatggtaatagtggtcatagaattaattagcatcttaccgattttgatatgttatccttgaatcatgttgctgccattgttaacagcaactgtctgttctcctatagtgttaataactaaatctcttattggcaaaggaaatgtattgtggagcaggtggcaaagaggacctgtgttacgtggccagcaggctagaggggactgtggccaagggcaggtgcgctaacatcgatttctgtgcttctaggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgagtgacagcatccaaaacaccgtgggcccaaccatcatgataacagcagaccctcctcccatgtgtgatggcagctttcctctgcggcccctcctggtttcacatgggggaccactagaccatcttaactagcactttgctcctacttatatgtcatcacaatcagtagtgggcagatacgtgatgtattcgtatttataaattctgtacatctctgtgagtgtgtgaaacacttataagtaggttctcaaactttaaagtgctgcttacagaatgcacagttaaatgtccttttatacacaggtgcacagttagatatttctctttcttttttcttttcttttttttctttttttttcttttttcttttttttttttttttttgagatggagtctcactctgtcacccaggctggggtgcagtggcatgatcttggctcactgtaacctccacctcggttcaagcggttctcatgcctcagcctcccgagcagctgagattacagacacctgccaccatgcccagctaatttttggatttttagtagagacgggatttcatcatgttggccaggctggcctcaaactcctgacctcaaatgatccacgtgcctcagcctcccaaagtgctgggattacaggcttgagccaccatgccctgtccgattatttttcagggaagagccagtgtgctccagccctatgagctctacccttctgctcccacagaagggaagcacaggcctgtggggtggagggggctctgccctaagcgcagcccctgtgggccacgggtttcctgtcccttacactcggctgccttgtttctcccaccccaacatgaaaaagatggagtgagcctgcagccctgagttgatattgctttttaaattgagaacaatataattacagccttgtactggttataaaactttaaggtctcatatcagagatacagcagtgcctttctcatctaaccctgtgtagaatacggctgttgagaatggcgtggctctctggctggatagggttataaaagtaaatcgtcttttcacctttggcttttaataagggaagggtattagaaaaaaagtaatttgtatgatgaagggtgatttgtgcgtgtgtgcagacagacacacatgcagggaggcaaatcagaaccgatgcgtgtttggctttggcttgtttcgctggtgtctggatttacctggcgacacttgttgctctgggggatcttagagggaagcacgctgactgacctagggctgaacagcaggctgacgaccagcgccgcctcccgccccctgctcactctatccctgcaaagcccctgccttgctccctgttcagatcatagtaaaatcggatgtatccgagtatttcagagtgcttgtctccttagagtcagccagtctgacctgtcagatcataatacgtagtagccgtttattttcttttgaaagcaaaatcatggtttcctctctaaataacacttcagcaggaactgtgacatttcccaatctcagttgcgcacattttgtcctaaagacttcttagctcttttactgtcttcagtccctctgcttcacctcttgagtgtgtagtgggattcaggcagataagagggcgaaaggacaattcgtcagagagctctgggtctccatgagggtgggcagtcatcagtctttccctggtccttatcgtagtttgaatttggtccaaggaataagagagacacttggcacagcttccctgccatacccgccagccaggctacttcccatagagcacgttaggcttggccaagtgagatcttcttgtcagtgcttaatccagcctcccgttgtttgtcagccctagctggaggcctcacaggagttcctgtgtccttccagtttgatacgaagtttagaccaagaaaagttcctttctgtggcacacctgtagtctcttacctgtctttggtggttgtacacgaacaggcagatatccacaactgcagaacaagtgtcatcgtctctcttaagaagtttcagggcagcctaaaggctcaccttcaccctaccaggccccctttcatagccaggatcttagggatggagaagaaagataagttcgcctcgttcactgaagtcgccccttgttttcaggttaggaaacccaggttcatgtccaagtccctgggcaagtagccagcgtaactgattgacctaaaacaaaggatggagcccttggggctctgcatagtgaaatgtatgatttcttagtggaaaacgagaaagccactgaggaagcccagaagggaacttagcatatacagccagctttggggaagggggaagcagtgccaagcaagacaggtgcttttcagagacacatgaatctctgtcactcacggatgtactctttgccccaggtgaaagtgacgtcctgcatttcacctccaccaccacgtcgaagaatcgcatcatcataacctggcaccggtaccggccccctgactacagggatctcatcagcttcaccgtttactacaaggaagcgtgagtttctgctttgggtgatgccattctgttgacagggctacgaatgggagaggccagtctttcgatccttgaatgggctggctgaatacagggggtcagcagagtccccagggagagccacgccaaacatccctacttcatcctcatgcaccctctcgggctgtccctgtgatgtcagtcacagccagtgacagccatgattgggaaagtgttagctcgaggcctgtcattctttagtgagtgattagagatgtttgaataaaataaacccaaaatggggaaagcttgctttttccagaattaggtcagtccagactcatgaacgatgatgggggacttcactgaaatatcgtttcagcctccttacctactaggcctactccaggaacaccctgcaggcacgtggctcttttgtatcatcttattcctgtctctctctctgtgtgcctctcccaagctgtggccctctgctctaggtcatgagccttccaaacaagcgaagaaaagtggagagagaacaaccttcatgtcttgagccttttgtgacttctcctagactctgttgggagcttttcctgtgtgatcacatgacattcacccatctaagcagccgaggcttattcctcccgactgcagccctctttgatctccctcttccttcctttgccttctatatccaggtggctaccccggtctacttagccatcccccttacccaggtcccatgttaatcccatagttctctctcccagatgtgtggcttccaaagagcagcaaccagaggcaccttatgacagcatcttgtactctttcctcctgccagagctggggtcctatgaatgagaaattgggtacttaggattactaggctttcagagtttgtacacaggggagcccctcatgatctcccatcccatgacagcagacggtgttttgttcatgtttgtttcagaagccagcggccagcagctgtccagcccttttagctgataaatataaaatacctacccaaccatgcatctgtgcgaagtactatattctctgatagtcacaccagtgctttggcaatgtcagctggtaatttcactgaggacttgatgctggtttctaaggcaatctggaaactaaatatttgaatattataagatgcttaagcatcagaattgtttatgagcaatctgaattttagaagctacttctgtttgtctgtaggaaagtcatttttctccaacagttaccttctttcaatatctgatatttgcattaactgactatgcttgtttttttcttgatgaaaaaatgctgcaatcagaagagagaaaaatagtttttgcatatgttcttaaggaatagtaactattgaatcccagtaactgttgaagtggctcttcctgaggcagaccattcaattctgtaatgcccgactggggaagcccagagtccagtcacttcatttcttcttctataaaagtctaattgattatttgtttatttagacctcccattatagaaagtgtgacatgctgggcctctggggaagatttttgagggttttgatgtcagagccccgaactttctctgaacttaattgtctttcagaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcaggtatccatgcctagacaagcccccagcatccacacttcttcacaagctcactggccttgcttgtaccaggtgtcattgtagggttagcagtgagctatgcctgttgtctttcttgtcaataggtaatactgtgtcatattcatttccccactgctaacacattaggctcttctgtgccattttctggcctcggtactatcttccatcatctcctgctttgtgcctgtgagcccaggtcctccagggtgctgggctggtttcattggaaggcccagcctggaaacagccgtcttcagctgcccttgtttcttgtttgttttgatgttcaatcctccaggaactgaaaccatgctgatctgtgttccacttaattcatgtagctcactggttttccatcttcattctggagcttatagagttccaaagaggtcaacaaaagttgaaagcctgcagatgtagtatgttgtggatattcagagtattcactgatgatgaggttcctccttcctttatctttaggttctaaaccatctcatttctcaactccagatctggaaacagtaaaagcaaacgttaatagtttccagtatataaaaactagtttagaagtaggaaaatccacttcagttttaaagacactgattgttttagtgtattggagcttctatcacaaaaaaacagtgtagcctgggtggcttataagcaatagaaatgtatttctcacagttccagaagccacaaagtgcaagatcaaggcgctggcagatttggtgtctggtgagggcccactccctggctcatagatggctgtcttttcattgtgtccttgcatggtggcagggatgcgggagcactctccggggcctctcatagaagggcctggattccattcatgagggcttcactcccatgacccaatcacctcccaaaggccatgcctcctaattccatccccttaggggttaggattttgacatgtgagttttggtaggggacacagacattcactctatagcactgataaacattctttgataatagccattattttagtgggtaaggtgtttttaaatacccataagcgagcacaaaatcagtttaaatggcagagaggagggtgagaagaaaatgctggtggggaaaaccttttgctgtgcacgcctgctccttcctccactcctaccccatctccatgaccctgtaagtggccacagtcatgtcactgggtaaagtgcttattgaaacaaaattggcacaggcttctgatcctgcgtgtgggttggtgtagcagaggttcagtgcaacagaagaagtttttcatcttaaaatttggaagtaacccctggccagcaattcactgtagtgtttgggaaacataggaatatctgcttattgtgacagattctcaagaaacctgtttcctttccgcaaagatggaaaccaggcactgtaccaatgagtcagttcactacgttttgtcctctgtccttacacgcagcggagacagacgagaacttggtcctctgcctctgctgtttggtgacacctatcgtaagaatgtatctaggaatgagctgtttgtttttgaagtacttatttttggaaaccctaaagtggctgagcatcaagtggttgtgttttctctgaaaacgccagtattagtcataacctttttccaaagtatcatcccttaaagatgttcagaaccttgtgtgtatcgtataacctggagcaccctcaagctgtccgcccttttcaagttttaaaaatggcttaggcaaacatattgcttaagtgatatccagtgaaggtgtctcctgtgctttgaaaaaccatcaacattgatgcttttttgtgacccaataaggacaagatttcagtggttctgggatgcatttgatctttatgcacacttcagctctgggtttcagttcaggggtcagcataagtaaagcttgatcagataactatgctttgcctataatcggcattcattctgctggtgacagagtcctttgctcaaaatgaggcttccatgcgtttgcagttctaaactgcttttcagagtcatgcctcagtcattgtactgaaggatgcctgtggaaatggtggacttccgtgttctttgcattgcctctcccccatccctcttacacacagctgtgacatgggcatgcacactccttcacacacacagactctccagccccctttccacttcctctttccatttggcttcatgacatttttatcagagattcaaaatctcagatgaaatccaagtcagcctgttttaccagttgtcgaaattgccggagtgcagcactgtggagaatggcagttgtaataaatgagaaataccaggtgtttgaattagctgtagattttcacattgtctcttctaaccctgcttgtgcccccgcagcctttttccatttacaactcagtaatgtttgttttcacagagattaccggaggaaatagattataaagggaaatgttggcatttatagtagtactatttcaaaataaggttcacttttcactttgtatttcattgttcattgttattttcttatccaggtcaaactggcagtttcctgttggcttgccagagtatctgatagcctgactcttaagttcatttcattttctagaatgttctttgttcccctctccagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaaggtaagggtgcagcagcggcctggacggagggtgtgaccgttcattcctgtggttgtaatgtgcctgagccctaatattacacgtatcagacaacagtgtagttctccattggaaaccagctatcttctggttttttttttttttttttgagacagagtctcactctgttgcccaggctggagtgcagtggcacgatcatggctcactgcaatttctgcctcccaggttcaagcatttctcattccccagcattccgagtagctgggattacaggcatgcaccaccatgcccagctaatttttgtatttttagtagagacggggtttcaccatgttgcccaggctggtctgaaactcctaacctcaggtgatttgcccgcctcggcctcccaaagtgctgggattatagccttgagccaccacatctggccgagaccagctatcttcttgattaaaggtactgagagctattatttttccttacaagcatgtataacggctttcattcccactcttgttttggcttttcttttccgagaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccaggtacccagctcatgtgaaatttcagttggcaaaacccactgctcaggccggttctgttgcctttctccccaccaggtagtgtgtaagtcagcagctggggggtacaatacagtagccactgagacggagccgaaaaagatgacaggttcggtgaagtgagtccctgcggaagccagtcagccctgaagggaacagggaccagggcttgggttgctggggccaccggtgtgacaggtactgctgtctcagccacaaccccccacagagagcaggtgggcaccctgtggtagaggcagggaggggaaactcaaagagtattgacagctgctgcctggtgagaggaaaggccaggatttgggtccatctctgcccttcctaattatctttactgcctctctcagcctcacagaggaggagtgaagcaagagggaaaaaagtcagagtctgtgctggaaagggcctgacttcaaaacatagccaggtgccacaggcatcctgtacaagtaagtttgggaagcagtgtagggcgacagcctgcattggctgtttattccgtggttactctgtctttcaaagcaacacagcccctgccccagggactctgctcctctgctgtggtcttggtttctggggagtggggacaaaagcagaggaaagtaaacgttcatagcaggactgttcatagtagccaaatctggaaacccagtgtacatcaacaggtgagtggctcaataaaatgggctcgaaccttacagtagaatattattcagccataaaaagggaggaaattttgatccatgtcacaacacagatgaaccttgaagacaccatgccaagtgaaacaaggccagacacaaaaggacagatagtgtatgattttatgttgtgtgaaatatatggaatgggcaaatgtatggtgacagaaagtagatttgaatttaccaggggatggggatagagtgtggaggggaatgggaattattccataatcgataggttttctatttggagtgatgaaaatttttggaaatagataatgatgatagctgtaccattctgtgaatgcaattaatgccactgaattgtacccttaaaatgattaaaatggcaactttttatcttacatatattttgttttgttttaaaattttattttaacacaataaaaaatgttaaacaatttttttttcctttcaaaaaaggattagcccagtagtgtgtgggaaaggagatggaagcacagtggtgctccctggccccctcttcctgtaagattatagtgcagattttggaaacgacctcatgcctgaaaactaggccaaggagttggatttaaatcagcatggcacccatgagctgcccatccgcagtccccacagcacccgctgccagcaccccacccagcacgttcccttcccctcactgcccccgaccctgagaggagcctgtagcggctatttattccacagtgactctgctcttacaggctttcttaggctgtaacaacaaatggtttttaaagtgattttttttttctgccaagtgacctttttgatatttgcaaaatggttgaaatagctatctcacttcgagaaatcagtaaagtgggaaataaagactggttagaactggaggcattatttccttttgagagtgcgcctcttcattgcttggtggcttttttctcctcccctcctctctcgaagttcaaaccaccagagcagccaggcgcggtggctcacgcctgtaatcccagcactttgggaggctgaggtgggtggatcacaagatcaggcgttcgagaccagccgggcatcatggtgaaaccctgtctctactaaagatacaaaaaattagccaagcgtggtggtgcacacctgtaatcccagctacttgggaagctgaggcaggataatcgcttgaacccgggaggtggaggttgcagtgagctgagatcgcaccgttgcactccagcctggacaacagaacgagactccatctcaagaaaaaaaaaacaccagagctgtgagaagggcctgcgaggccctcatggcctctcctagcctgccccgctgggggagtcttctgcctgctggtgtgtggcagggctttgaatgtgaaccttgaggttcagtgcccaaggccattttcttatccaggatatctttgtatcactggtggttcctagaaagcagaaagtttgaggactagaaagattgcaaagaggtttggaaactggaactcaatgaggtttggtgacttctctgacatcctaattaattaagaatccgtttgggacctggtcctcattcccacacaccgactcttttccccctcttctcctccattgcgttgcttctcgtggtcctttccacctagaccagcagaggcttagctcgtggcagctcctgctgcccgccacacggaaggatggatttagagtgtcccaaagcaggctgggcgggaagtttgtttttctctatcatgggcccttggttacgttgctgtcttgttccaccaaccagcaggaggttcgggttgtgagtcaaggttttggaaagattttgctgaaaggccccttgctttcagttgtagttacgaggcaagacctgtttttttctcatcagatgtggagcacaaggtgaagtgacgtgaaggcagagctgtgattgacatgttattaatgcacagcattggtggtgttgggttcaaaacaagtttcctgtgttctactggagaagtgtgtttatctgtcccccgagtccttcctttctctctcctaagacaagtccaacttgtgattctctgttttcatggatgtatatgaagacaatattttgtccgtggtgagaggccataatttttaagaagttaatatttgtttttttgcctcctactgagttctggcagagtccaggtgaaggagtgtccagcagagagaatgactgaatcacagaggctggctttctgttttacacgtggattgtccgaaaatggatttgatttctttcagttcattctgagaacaatgtatttgtgggataaaaccagttaagtaagatttagttccttataaattgtccagaatatcctgtatgttttgaagtacagtggaagctagagtttgtaaaacttactagtttctgaagtcaatattcgcagtaaatgcctttctttgactactgtctttattttgtaaatcacatagtttggtttaactagctaaaatgttgacagatgttggaaagtaaaaggttttccaatagggctaggttgtattatgggatggagtggggaaagttggcagtaatgtttgcttttgggcgtacgatttggaaatgtagttgtttaccaaaaaaaatgatgtatgggccattgtgcttcccctgttcctgccttccagataatgttctgtgtcacctccctccccttgtcactgccttgatgtcatcagcattgagagctgtgcagtccctaaaagtgtgatgttgataaacaagtaaactactgagtatacttcatgaagtaatcccagttaaatgggggtgggctgagccgggagaggggttttgacagaattattttgcggtacatcaaacctaagcaacttctgacagacacaagtgtatgttgtgttggttttgaaggtaggcaggaaatttgttgatgatgtgttgacaaagatttccctgacagtaaatgtggtttcttgtgtttttcccttccgggaagcttggttagctagttggttggtttgcagagtgtgaggattgtggatgatcagcctcatgtccttacccttcctcccccagtattgtgaaagcaaatgtacacgccctgaccttgtggttttctgcttgttggaacgagcatatctgtgttgggcagttcatgccttcggtaggacccccgtgtgccactacacaaagaaggaccgtgttttcctcaggggaatccatgggctgagaagactggggagcctcagaggccctttcccaaagccctctgctctccccttccaggttctgacctaaggaccagccagaagcctgccgagcgtcagccgaacctgcaagtggcttctgggctgttccgttccctgcgtgagctttccctctctgctgctgctgccgcgctctcccctccatggcactgatgagcttcccacattctggactttctcatttccctgggcagatagaattcatcccatttgccccctgccttttgcctattcctaagaccggtgaccccagccgaaggcctcagccctgttttctcaccattcgtccatggctgacctgagggttgccctttctccatctgggtgctcctctcgtattctgtttgtttttgttggttcctgtaaacattagaattctgttttaaggtttctagggggagccacaaagcccatttcttcatatttgaccaaagcagcaattagagggtcgcaccctcatgcctcatctgccctttttggtgagaatgtcctttttgtgatgactttatgcactcccttttgcttttcggttgttccaagccccattcaaatccatgacaaggactctgctctctgatgggcaggaccttgatgaggccacaggtgctcactgctgagtgggaggaagcctgggtgggctccagggacctgcagagtgtagcaagcacagacgcttggggttgggggtgggctcgcagcaggagcccccaagaagagagagccctggggtccgtggaactgcttgctgctagactccaggcatctttatttccacagtcagagcaaatccaaggagccaccaccacaggctttcatatccctctgccccaggtctctggggcctctgccacacacctcacctctcccctcctgccctaataaatcttaaccacagctgataggtttgccacctttaaggcttaaccataaggtctgtgaccagatggcctgagtgttctgatgacacagccaggactgcctggccaagagtggcagagacactatttgcctctaggtaaaatcgaagaaccactctgagagccggggggtgggggtgagagtttgtgtgcccattctgacacttgcagagtagagaaagcaagataatgaggaaggacatccctgtgttattcatgagttcttacctaagggggctcaatagctccttctattccatggttaagattcttctgttactcttactcaagtcatagaaaagacaaaagaggtaaaagtacttaaaagccacatttctctcctccttgcagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcaggtatggtatgatccagctggccccattgccaccttcctcacaacctagtggagaagatgtgttttatggacacagggtctgacacccagggccatgacccttagacccaggcctgcctgctaaataacgtgcagtcattggcaggtggcgtgtagaccagctgcccagggaacagagcccacgctctcctagtgacaccactcccagcttggtctctccatagaacgtgctgggagcagggagctgtctgcagggtccaccctccacctgctacttggtgcacatcgtgcattcctgctgtcctttgccccctcttgcgcacaaatcgggttgccccctcctgagctctcacatgtccagagatgtctccagttagttgccttgatccagagtaaacattgcccctcaagatcaactcctggagtagcctctggtcttgcttatttagtctttggctttcccttgttgttagacactgcctgtcactcgggcattcatccatctttgaaggtgggtgccttcaaagacagaacaagagctgccctgtcctttagtaggcctcaggtggtagaaagagcacggaggtgaccagagtctggggtgtggggtcctcctgggtgcagttctggcactgaagtccattgtagcgtgccttgaggcagtcgtcaggctccctgcctcagtttccttagccctcctgggagagacatagccagctaacccctcaagtgccttttccggctgtaactttccatgacctttgcttatcacaactttgtttactgcttcaagaagcaaaagcaagaaaggaaccactgcaaggtcagccagccgctggaggagttggtgccggcagggagggcttgccctgctcttagcaccagcctcctagcagcttcctcacaggccgggctcggggccatccttcgtgcctgcataaaaattgcagttgccgcgtgtagacgcgggccacggagggtccctgtcacagccggcaggccccgtgtcctgcttctgcttactcagcatctttccagggctgcttgtgtttgatggcttcacaaagctttcttttttcaagtggtaggcacagggtagaagaaagttacttaggttgccaagattttcctgctgtgcttggcagcaggctttttttgttgagggactggggagaaaggaggatcttgtggcatcttgagacgtgcaagttttgtggttggtgtattctgaaccctccgctgtgtgagcagcccgctcaggggcagtgtacgtggctgatctccactgtcctgcccgcgtggatgggggggttattctcagtgtacgtggctgatctccactgtcctgcccgtgtggatgggggggttattctcaggtcagcccagtgttggcctccctccctgggaacccaaatccaactttgtcacctgtttaaattgtacagaaggagcagatgacattcctgggccagtgacctgggagccaaggcctgaaaactccatctttttaaagtggccggaacctgagaatcccaatggattgattctaatgtatgaaataaaatacggatcacaagttgaggtaggactggggcagtggcccgtgcctgcatgtacttccatccattgacagcatatgctacctgactgcacaggttacctcctggttagcataggacttaaaacaataaaatccatgccaagttggtgaggatttgggtctttctacccactctgtactctccaaggagtactgcatagtgtgcaaagagctaggctgctttttgccctcaagaaacgatttcattgtgtaagataaccttgtggcataggccaggtcagttctaataacttttaatccttctggagttcttggttacaaaaatgtttggttaaagcttttgggtgtgcttaaagctacttgaagacgaccttttaagatttgatttctttgtctttactgacactcaggatcattgttaggtgggaggtcagatcaggcagctggagtccccagtgtggtgagtttagttggcaggccccagatttctcctgcattcatgggaaattgacatgtatgttttatttccccaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaagtaaggcttgtggagggagaagaaacgtggtaaaactgaaagcagggtggtccaggatcaggacagcccgagtgttcatggctgtcttattttctgttaaaatggagttggccagcttccagaagggtcatgctaaggtgccggcacataccggcactgtgtgtgaaaggttgggcagggcagatgccgagctttgggctcctacctcatgtggcaggaagggagaggatccgagcctctcctttgaggttgtgtaaccactggagagccagaggagacagttgctttcaacctggcttacattcaaagacttttttttttttttaaacaaaagacattttataaagcattgaattgaccattccacctcctacttggtcagtaaagctagatagggctcggattcagggcttgaaatcctaaggggtgtaaggaactccagaggtcatctggttcagcctgctacagggcaggaatctccacggtagcatcgcagaccctccactgtccttttaaagtccccacatgcattggaaatgtacggtgctcaccctttggtacagagactgaggaatgtgagtttatgctcaagtcattaacaagacagaattcttaggctgttctgtgtgatgacttcagattttaaaacaaattataagatgtataagcgcaacaagggccacatacttgttgtttgaccaacaaaacttagtattttggtgaaattagttctgtgttgagtttctgttatttcttatttcaaacccagtttttaagattatttcatgttcatggaatgggatcaaatttggcataacacataaaatagcaatgcagcctcacttagtggtaacacttttgggtctagtgggctgatctttcctggtgtccacatttctgctactcacatctggagttacgttaaaacatgcactccgccgggtgcagtggctcacgcctgtgatcccaacactttgggaggccaaggtgggtggatctcttgaggtcaggagtttgagactagcctggccaacatgggtgaaaccccgtctctactaaaaatacaaaaattagttgggggtggtggtacacgcctgtaatcccagctacttgggaggttgaggcaagagaatctcttgaacctgggaggcagaggttgcagtgagccaagatatgtcactgcactccagcctgggtgacagagcagaactccatctcaagaaaaaaggaaaaaaaacaaaaaacagcgcactcaataggtccagcaatctcacttctagtatatttccaaaggcaatgaaataggtatgtcaaacagctctctgcactcccatgttcactgcagcactattcacagtggccaagacatggaatccacctgatgtccatcactatgtatatgaatggataaagaaaacctggtacatatacattatagaatactattctaccataaattagaaaagaaaaatgtcgtttgtggcaacctggatgaacctggaggacatgatgttaagttaaataagccagacacagaaagagaaataccacatgatctttctgataatgcggaatctaagaagttaagctcatggagagtagaatggaggttaccaggggctgagggtgagggagcagatttggggagatgttagtcaaaggatacaaaatttcagttagataggaggaataagttcaatagatatattgtacatgatgacagtaataatgatgtattcttaaaaattgctgagacaatagattttaagtgttctcaccacacacaaaaaaatgtgatgtaatacatatgttaattaggctcattcagctgttctacaatgtatgcatatttcaaaacaatatgttgtacatgataaatatacaatttttatttgtatattaaaattaattaattttaaaaaagatctccagtagtcacctggtcagcaccagatattctaatctgtttgtgatatctgaaaatcctaatacagacagcaaaagcaggatggggtgaatagaactgcaaatcttgagccaacattttatgtgcctggcactgttcctgggttcaggtttttaggggtaaatggatgtttaggcagataattttgtcaattaaaatagtctgaattgttccatctagtccagttaacctagtctcaccagttagtctatgccacctttgcagcacccagaagcttcataatattcctgcagccttgtccagggtagtggcttgcttgctttctatctttccccagcctccttccctcctctttttcctcccctccatctcctagaaacagatcctagtttgggggtctgtgatctgtgaaacagcaaccttggcttctggggttgagtgaactcagcttgttttggtgacatgacatgttcctgtctgcctttgctgctccatttttaaccttgtaagtgccaggatgccagtgggaaatcgggagtccttctgatagaatttttccagcagatgttatcacgtactgcagggaaattggatctgcgtgctggccttactgttgagaaatttttccttatgtcagacaagactctgtcctgctacagtttagtctcatttcctcttatttaatcctcagaggagatggaaggtttggaagctttcaggcaactgccttccttttaggaactccttgtgtgcctgaatactattaaattactcctcagacttctcttttccagatgaaataatctcaggtcttttggccttttcttgtagcccaatatcatacaccagtttcctagccatttaatcatttttgttattctctggatgtgttccattttctccatgtccctgttgaaatgtgaaactcaaaaagaacacagtacagcctgaccagtagtataagtgatataaacagtgatataagggccttgggggaagaaagaaaaatctgccagctttccgttggtaatgatcacctctgagtgtttttaggaattgcaaaatgctggagcctgcatccattttgagagctacaatatcaataaaaatacttctttcttcgattaaaatacttctaattttaaaaattaaaatagctgtagtagtctttaaagagtaaccatgatcacagttttccatggcaaaataatcattgataggggacttacgattaatgtttacttgatccccagtgattccaggcccatttccacatagacatctgtatttggacgtcccagagaggtctcagattccttgtgccaaaaccaaaatcacagttgttgccctcgaaaggcctcttctctcctttgctccttagctcagtcagtggtcttgtaatccatttgttacccaagccaggaacctcacagcatccttcactcttctttctgttcagccacccctttttcattccaacccaagcctcatggattctgcctcttaaatgtctctggaatccagccctctgtcaccaccagcaccgccacagctcagactccaggtcactcgccttggggggatggtatgagctgtcatactgtatgagcctcatcctggggccatgacttaccaagccagatcatctctgtgagtctgcctggtgtaaagacaaggatcagtgacttctttgtaggtctgaactgggtaatgcagagcatgccctggagacatggcatgtccccccaattctccaagacatgacagtgccttctcttactgccaggtccctccgtctgtcctcagcacagccatttccctggaacgcgaatctgatcagttcactgctgggcctgaaagctttcgctgactccttttaatctgcagaatgagggtgaaactgcttagcttgggctgggtcccttgtgagctggccctgacttctctccagtatcatcattttctaggaaagccatttccccacaacccccaaggaaagcatatcataaacaagttttcccttggggaggttccctcgactcccttctctcctctcccttcctctctgaattgttgccatatgtgaagtccacttttctagttgtcatgctacctgttgacactaatttcccatgtcccacagaatgttccagggtatgggtccatgtgcctggtgcccagcctagcatctgccatacaagtgctggttctgatgatcagtggcttctgtggtcttagacttgtagcaggactcaaatgtctgcagcggcattggaaaggggtgccgtccagtgtgtgcatgtgtgtgtgtgtttattttaaattgtctatggaactatctcaaagattgaggccagcaggacttgacctatacatagatgtagactgtacatagatgtaagaatttctattcattttatgaaaatgaatagaaattttcattctatttattagaaatagaatgcttgctgctgcaagcatttgagtccttttacaggtgtgagatcacaaagaccgcttaccaacagaaccaacacttgtatggcagatgctaggctgggtaccggggacatggaccaaaccctggaacattctgtggaatgtgggaaattagtgtcaaatgtatgcattttcactaacagtcattaaactgcgtacaaagattatttttcttcagtctatcattgaaactattgcaccagaatatactgtactttaaaaaatgagtatatgcctcagtctgcacatatttactcttttttcaaataattgtttgtttgccgtgttctatttctgacaccatttaccttcaggaattcttactgtatgatggggagtaaacgaatatacaggtatttttttcatacttccaactgaatgtgaagaaatgaaatgagcaaattgttcacctggtgatattttatcatttcctcctctttgctgcagcaggatatgaaaacttcatccatctgatcatcgctctgcccgtcgctgtcctgttgatcgtgggagggttggtgattatgctgtacgtcttccatagaaagaggtcagtgatgtgcaaagttatgacactttctgtggctgagtggtttgatgatttgaatgtgagtgaaggtgatatttttgaagatttcaaggaaatattttatggactggaaaacctgattttcccatcaaatgttcttccaggaaaagagaaccttttctaatgattttaacaacagccaaaataatttttcgatggtacagaccttcccctggctggcttttctggtatacagatactgctgctggtgcatacttttccaaacgcgatgcgctagccttcccaatcaaataagcctttttatttccaatgaagtaaagaaacagatgtttcttaaaaagcgctaatctcaggctactgaggaagccagaagatgtgttagcaaatgtctgctggctcacccaggcctgaattgggagtgtagacaagagctgctgtagacagtaagctctccccattctgttctgataccgtgtgagagaggataaatgaaactgttgtagcgaagatgaaagtatatacaggaatgtatggaggtggggttttgttaacgtgaatttaatctttttgacagaaataacagcaggctggggaatggagtgctgtatgcctctgtgaacccggagtacttcagcgctgctgatggtaagagtccgggccaccagcactgccagcgtgcagggcaggtagatcgggagctttcaggagggttgctaatttgggaaaggaaggaggtttgcattattttgagctacctttggccttggatctgtcttcattaatatttctttctttctttttttttttaatcaaagtttttagcagttcagtgaatatgtcaaaacttgtgggactgtatggggtgccccaaggaaacacaggctttagagatgaatgtggccagcgcagtaatcaatttatttaattgcttgagatgttatgctagaatgaaaacagctttttaattgttaacatctagtcagaggatatgctgcagctgacaaaacagtccttttaaactagtttcagcttgagtatcatctcattataattgtctttgatgaattacagctctgcttttttttttatcatggaatttttctgtcattcccttccgactagggtcatacgctcgtggctcattcacattccccttggtaataactaatgagggccattcagttaagtggctgggaaggtctgacatggaagttgggtgatcctcaatggttatttccttttttgctctttctagcatttttatatccagaccttttgagtgagtcggattagggtgaggggttggtcactgagtccagtgatactaggacccttaactggcactttgctaggggcttttacaaacaccatcccatttgtttcttaaacccctgcaatgtgcgttttcttaatgcccatctgcaggtgaggaaatgaactctgggaaaaaacttgtgcaggctcacatggttagacagttgagaagtcaggaggagaatggaatcactgtggaaagggctgtgaggtcccccgggcaggcaaggaaacagccctcaggaggggctggaccggattcatcaaatgaataataaataagtgcatgatgttgagtgagtacatttagaaaaagtgtttgctgtcttcttgcctcgggagaagtgaaagtagatgcaggagatgtgaaataaagagacatgattattctaattattgtgatcaaataagaaaacataagaaaatactttaataatgtgaaaacaccgttatactatgtagggttttactatggtttctttaataatttctaattcagtttatagtaaagtcaatcaaaagcagcctcctctgaatgggaatcaggtgcagaataatgactttatttctatctacataaaggtctcacaaagttggttttttaatagtaatatatatatacatacttctgtagtgtgtgtatataaggcagagagaacattctggacggatgcacaccacacttacaagagttgttacttgtggagaggatctttccctttaaaaaaaaaaaaagccagatgtggtcgaaggcacctgtagtcccagctactcgggagactgaggtgaaaggattacctgagcccaagagctgcagtgagctagaatcccaccactgcactacagcctatagagcgagactggctcttaaaatccagcaagaagatagatatgcattgtttgtatgaataatagcttctaaaaagaaaatcagtaaggaagggagtcatcccagatgatggaattgatagaacaaggcaagaccactttccccctctgtgagggtggactgtgactctacgagagaagctattctgctttgaaatgcggcactagaggttggtgtgtgtagcttttgactgtgaagtgtccaggaagagaaagcatcaatacaacaaattcagattctcagggctctcatggtgacttgaattcacattttgtgtccttctagaatgctttcatgatacgtcttggtacttcattacaacaaaaacaaacttattgccacccaggtcgacaggtgggaacagtgtcaccttatttgaacttaatttattcggcctttgagaagcacttatagccagtttcctcgaggggcaacaaaatgacattgcagttcaaaagtgctttaaaaacttctttttcccaaagctataatctgcatgtcaccattctccagagtacattgaaaatcccctacaggaaagtgctgataacattgtgcacagaaaccgctcctggctggtggcactggggacgcctgcttaaagtcggagccgttgggttgaatcgagagaaaaggattgagcgtattgacttcagggacctcccagggaatgaatgtgattggtttcaactccatgttttatggcaggctaaacagttaattctgattaaaagcaagcctggattctcagagataaatggctggagacagtgaactctttacactttctgaggcgcattgtgaagagccttatctcctgggttgtcttgcatacttactctcctctgacaagcacccgcctcttcttcaggggtgcaagccacctatgccagctggagggcagagttccattcgtgaaacccttgaaacatacgtactatgaaatacaaaaatgtgtaggaaagaaaacaagattattaatgaagttcatattggacacccctcagaggtctaaaatgatggtgcccctcctgggcctaatttataataaacatctctcctttgagacatcacttaaaggttgatagttgggatatggagatgttaggatacagttgtcagcctctcacatccagccacaggcccagggtcagcatctgaaagcatgaaagcaaaaacaggcaccttctccacctcctttctgagccaggaccacctccttcccacagtcagtgtgtggtagagcctggtggcaggtcccgtcaggcaaggacattagcacacagcgtcagaggaattactgacatttcatatggatcttatggaacaggttgattttattttcgtttttaccctacccatttggaggtgtagaattgagcctgtgtttggttttgttttctttctttccaacctttttcctttctttctctttgttttgccttccttcctgcatagaaatatttatttattcattcattcatttttttgagacaggttctcactctgttgcccaggctggagtgcagtggtgcagtctcagctccctgtagcctcaacctcctgggctcaggcgattctcctgcctcagccccctgagtagctgggattccaggtgtgtgccatcacacctggctaattttttaatagagacagtgttttgccatgttgcccaggctggtctcaaattcctgggctcaagcgatcctcccaacttggcctacgattacaggcatgagccaccgcacacggcccatttattttcttaaaccagatcgaatctaaacagaaacagaaactggagaagaaatcctattcaggcttggtatctactgtgcattcctcccaaatctctacccattggtcaaggtccctgagttcacagagcccaggccagagccctggaaacgcctctgcccgtccgctgcctaattgcctgtccacgctgggcaccaccgggtctctccctcagtctcagagctcagttgcttctgcacctcatcagggatccagccatcaaagccaaggctgggggacacttggactagagtaatcctaccaataatgcagttcagctttgtaaccgcaaattttctagtagccgtattttttaaaagtaaaaagaaacagatcaaatgcattttaatagttttttagttccaataatacgtttcgtgtaacccagtatatccaaaatatccattttaacatggagtcagtattaaagttacctaaatatttcacttttttttttttttttgtctaatctttgaaatcccatgtgcatgtctcaaattggactggccacatggaatgctcaggagtcccatgtagggaccagctgccatgttagatagcccaggcatagcatctgtgttgagggccctgacacctcttttggattcatccaagaagtaggaccttacgtgcaccatcatcacctctcatatgtgactctggcctttttcccgacccagcataagaactcttccctctccctactactctcctcctttttacatttgcgttttaatctgttggtgaagatgggtaaaatcctgcttgaccatttcattcagtttctcaatcccctgtggttaatttgtttttttcaaaaatgtgtttttatgtgatgaaaagaaatttttaaaaaccaactgctttctttcctatactagacttccttgctttgttctggtccttctatctgttagtatcctcaaattatcttgaaatcctcagagatctgaaatactagtactgactgtacagttttcttactcaaatctatagcatgtggaaagttgacagcaagccatgccatcgcctcctggtattctctgtgggtttaaggaagcagcatcttatattctttggcttagagttcccccaaagcacgttctgtctaagggcttgtttctgtacctgctttaattacggtttcttctccagtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtaagagaaagttcctgaaaagccaaaatgcagcacagggagagggtatcacacaagcctcccagtatgttcttggctgcatgtacccgtgggtttggtgtcttgcctttgccttctggatagttaccccattacctcactgctaccttcagacccctgtgctcagaccaggccgcagcaccacagagacagttccagacaacacaggcaccagcaagggccaccctgaccctctgagtctttctctttttgattcctcccaggtgcgattgctgggtgtggtgtcccaaggccagccaacactggtcatcatggaactgatgacacggggcgatctcaaaagttatctccggtctctgaggccagaaatggaggtcagttttcatttccaccggtattgcatgttgcctggcctgctctcttttcctttataatctccctgcaaggaaatgctgtgtctttaaatcagtttactttccagcatccagtgtttcttactgcatgctcagttgtaggtcatttatgcaaaggatttccccaactagagtcagactctgatcttcgtgaggggaacttcctgttccttggatcccctctgctaagcccctctgtgcctttgttcctgcattccctccacccccagtcccctccccacatcagtgtccacctgccaagccaggccagcgccactccctccccgaagctttcctgccccactccagtagctatctcctctgctaacttctcgatgcgcttgactcacatcctcgtatgtgttctctctcgttatgttgtgttgtgctgttgttggagtgtgtcccccctccaccccgttgtgtttagcttttcatctcagtccaagtgtgtggctcagggccgcatttgtggcaggcactctgtcaataaatgtatgttacagttcaaggttaagctgcctggattcttgcccttgcatctgggaagttgctgggtgatttcccacccagctccgtgcgcaagatgtgcactcattcataaaccccctccccacacacagtccccttccccggcattgttggcggtccttgtctttgccactgggaatctggtttcctcagactctacgtccacgtttcaggattgatccagagtcagtgtcctgcttacgcttttgaatgaatgatcccacctcagctgcaggatttctgcttagtttcctaaaaatttcactttgggttatgagcttccaattctaaacctgctaaagtcctatgcaatttttcattaaaagtcaccgtggtgtctcccccctctgtagtattaacccacaggccagctttttaacatatgcgggcatgacttttgagtaattaattctacaaataaactgggagataaatgctgagacataaagccagcaagaactgagttttcatttggttgcctccgtgggtctgaagtctttgacccttactttgctgcttactgggtaagcagtgtgtctgcttttattccttagaagcagtgacttccccttctcggcccctttggaaattcttttgctgttcttcatttgggcttaatttttttttttttttaatgttctttgaatcggcaacttaatcatctcccaagtgacagtttcttaattttagttccaaacacctgttcacatatgacttcatgtatttgcagcacatggtgtttggggccaagtgtggactggggcttcaagcaggatggtttacaaaactcccaccctctgttctgccaagcattggtccccagcacccctgggtgttagtgcctcttcctggttcactcactcactttctctggccctctctgtgtctctctcactctctttctttcgagatggagttttgctctgttgcccaggctggggtgcagtggcatgatctcagctcactgcaacctccaccacctgggttcaagcgattctcctgcctcagtctcccaagtagctgggattacaggtgtgtaccaccacgcccacctaatttttgtatttttagtagagacggggtttcaccatgttggccaggctggtcttgaactcctgacctcaggtgatccacccacctcagcctcccaaagtgctgggattacaggtgtgagccgctgcacctggcccttggttcactttaatacacaaaacagcatgaaggagaaaagcttgatgaaataggtgactggagatctggcagagtatttcttgccagcatcgattgaggcacctctgaaaagtccaaaactcactcccttcctctccagtttcaggcacagaataaaaattcagaacacatggccttggtcctggctctgtggctggctgcctgtggtcctcagacagctgctgcaggttcctgggcctcagtgtcctcaatatgaaataagagggtgggacaagattactgaagtccctttcagaactaaaattcacctttagattggtcagatttaaactttttctttctagctcatgtcaggtattaaaatgtgtgcacttaccctgcagtttcattatattcaacctgctcccccgaccaagtttcacttacgtatctcactacgagtaggtgtatatgtatacttgtcttaaatagctctaaccaaattaaaggaaagaatggcagtgtaacaccatgaactgacaaaatttcagccctctgtctttctccatgcttaaagttgagtgcttttgttgattctgttgctcacggcaattataaatgaccacttcataacacatataggtcatactgtaatatttaagaattgtgagcataaactttacatttcatgtgcatatttcctcatgcatcacacgtatctaaagccctgaaaagtagtgatttggacttacccccagtgacttaatgttgcttccccagataaccacgtgataagtgttttaagtcaccaagagacagctttgacagcctgttcagaattcaaaggtttgtgtcaccaagtgtagagaaccaacccagaagtaccgaggagttgttataatgattccaaatactagctttcagtagaaactagcacctcacagggcagcagccagcatccactgggcattgactatgtgccacgcaccactgggcactttctgtgcgtggccccaggtcatcttctcgtcagtgaaaccactgtgataccccatgtggaaaagcctgggcatgctcagctggtggccggcctgcaagtgtgggacctgtcagagccctatggctttgcagtgctgtgtgagatgctttgtggtcaagaaaaccaaggtgtagagtctgttgcacttgtatatgcaaaagtaaaaggtaacattaaaattagggactagtgattgttttaggatggagagacttgggcatgtgttttatataaaacttttttctaaatggatgtattatttaagggtaattctttttaattccaaagccagcacgttgctgtcctctgcaaagaggaatgcttatccctgttacttattcctggtttcctccaagactagtttcagctggacttcagttgccaaggacttgtcttctgtaatgcccacagaaaataataatgccacattgtaaggtgaaaacagtaatcctggtatttttgtattttagaagaaggttgaagggaaagaaaaggattaaataatttataacgatgcttttatgggaaataaaatataccatgtccatttggaaacacatttgcttacttccacacagcctttgtaacgtgctctccttcctcttacctgtacttcggtgatggaaataaaaggaacatataaacaaataggaatttgagtaactgagaatccttactaccaaaaatggcttgtttcactttaaaaaaatgttgccctacccaaaatagaaaatgttggtcctaaagagtgcaaattggtgtttccctcaccagctctgatgtggtcagggagcaagtgcaaataagcttgcggggagcaagcaggtgccatgctctccatgatggtttgttccttccgagcaagtcctggtttcttagcataaacaacccacggtgcccagattgaacaaagatgatatgcaaacctcgaaagaaattggcatggaaaaaaaaaatccaaaattctcatgtgaatttttttaaatctccaacagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggaggtgtgtccttagctttccaggtctgggcaagaactaaactcaggtgttttgaggactttgttggcattagtctgcccctggagaggttttctagtgtgtcccttgagtgcacggactccttcttgggaatgatgtgattgtctccagttgatggtcacaaacctggcacggtcggtcccaatgctgatagctcatggacatggtggttcagatactgggcacggtccctgaggctggctctccagacgtttgaggcatttcttggtagaacacctcttagcattggttacagaaataattaagacaatgtcttcaggagattttgacttgggaataaaactcactgtccaaccttgcattcatccctccaattttcctagcttttaaggagcattgctccccttccagggacccacattggtttctaagaggcaagctgccctaatgacgaagcctctgcacggagcaggagcagtggcaggagctggcatggcagtcccttaggtgagggacgatcactgctcactgggtttcacggctggggctggccagcctccaagctctcgaccactctctcacaacacttactgtcctgctcttagctcaccagcctactggttagactcccttgttgccaccacccactgtcacaccagaaaaaagggttggattgaatttctgagcaatggttaaaacccacttcagcctttaggtttgtgtttttacttcggtcttttaatctgcctaataaaaacacacataacatcagggctgctcaggaaaccacctgcttttaccaggactctcatcttcccactatgatacaatgatagtttagaaaaataccaaatatttatcctgagaaactgcaggggagatttaacacccaaaagaagctatttcaaatggacctctgtgtctagttcttgaactgccttttctggaagtgttcaccttcctttagtaacatatttttttcctttagtagtgatgttttaatgaaatgttttagcccctttggtgaacaatgagaatcttttagagaacggtttctttttttgagacagagttttgctcttgttttccaagctggagtgcagtggcacaatcttggctcaccacaacctccacctcccaggttcaagtgattctcctgcctcagcctcctgactagttgggattacaggcgcgtgccaccacacccagctgattttttatatttttagtagaaacaggttttcatcatgttagccaggatggtcttgaactcctgacctcaggtgatccacgcacctcggcctcccaaagtgctgagattacaggcgtgagccaccacacccagctgagaatggtttctaaagtaggggtgagtgtctttctttttactctgtaggagctagaggtattgaaatggaaccatatcccagagcccacatccctccgtcatcagagttcctcattcaggatccaccagtgtgtccctaggtttggcacgttgagacgtcctcacgtttggtgctctgtgaagctgggcagccctcagagaggcaaagaagtcccaagaggccgtcctgcctcagggctctcaggaaagagccgcccgcgtccctggctgggcttccttggtgcacccagctcatttctccttccctctctgtagaactcacattgtccccgtggaaatgccagccagctcccctttcccagtgcaggggggagccaggtgggcctgaggtgggccagttctgccgctaatgggtgagagacttgggccaggtgccttacatccgggagcctcagtttcctcacctcggaaatagggtgataatgtaacagaccccatggggttatgagaaggacttggtgcaggaaagcagcagcacgtgcctggcacagggcagggcctctccagatggcagttcctgtctgtgtcttattcccaccctccgggcacatggggggaactcagtttctccccactgcgcgtcaccctgggagaggtgttttttgtgccaattgccattttaaatccaaatcagcagggatcatgtttgctgttcaaccatgtggcatatttatagtgattttttttgtaatcatggtttttctttctggaatttcaagtttttcatttgtgctgaggaaggtcgtttgtgttttttaataggattccttcttttccaccttgtgcaagtaaaggcaaatcccctatttgcatgtcactgtattaattcacagataacactttcacacttcatttttattcttctcaagggctcaagatgttttcccaatgcccagcgtctcatggatgacaaatatgacaagtaattttaccagaggcagtttgagggctcttagcatagcacaagtaaattatgttggttcaagtccaaggaactttgttctctttgtgtttgcttttgtagccttacctctttggggcatgagttagagacatacatgagcattttaaagtggagcagccctttctcctgggaaggagaacggaagagtccacttaagaaaaggttgtatgattgagtgcaaaatcaaaatctgacaaagcagcaataatttaggattataaagcgagcctgccatcaaacataattatgtggcatcttctggagacatggaaaatggaagaaattttcaaaaatgagtgggaggattatgttgaaaaacagtattgagtaatagcttcaggggcctcgtaaatagcatcttttcggcatcttactgggtacttttgtcatcatgaattgttaccctgaatattttcccccttattaagcagtgaaattatttacttttctccagtggtggggcagtgctaccaagttaagtaagcatctgtactctcctgtttatttggtcaggttttaaaaccatgtgtaaatgaccagtggtctctgcagtactatatattttcttaaattgtgggactctaatttttacaccgcttccttttttcttatttttattttcaagacaggttctcactctgtcacccaagctggagtgcagtgttgtgatcatggctcactgcagcctcaacctccagggctcaagtgattcttccaccttagcctcccaagtacctaggaacacaggcgcacaccaccactcacaactgactaatttttaaaattttttatacagacagggtcttgctgtgttgcccaggctgatcttgaattcctgggcacaggcgatcttcctgtcgtggcctcccaaagtgctgggattacaggcgttgagtcactgcgctcagcctgcctctcatttaaatgcaataagggcattaacttcctaagggaatcaaattgtaaatatattaaaagtggagattgcttggtatttgctcatcatgtgattaatcatcccttactgtctccaccttataaaattgcaaaccctaatatttggccaccttaaagtgggacgtgtctgtgtcttgccttgcgtctctccacacataatgagtgtagggtcctctgctgtgacagcagtggtgcctgctccagcgtgtgactctgcgccctctcttcccttacagattttggtatgacgcgagatatctatgagacagactattaccggaaaggagggaaagggctgctgcccgtgcgctggatgtctcctgagtccctcaaggatggagtcttcaccacttactcggacgtctggtatgagaacctttactgcattgccagcctggagcccccagcctctgcactttccaccagctcagtctctagggctttatctttctctgttcattgttacccgttgccagctttagctcagtgttgtgtgagccacacttcttcatcattgaggtgttcctgttgtcagtgggctagctaagggcagaagggcattcgtgggattttaaagaatttatgggaccaacattctttccgccttcagcagataccgattatgtttccaggaggtgggatgtgccagaagccgtcacctctttttgtttctcccctgcctgccttctttctcttttcctctttctcaataaacagatactgtctgtgtgtctgcctcacctaatctaaccctcagattgcagacagtgctttatttagacccaaagcttatgagtcctgattgtgttttcctgctggtcccatctgctgtctgtctttcagtgggcatccaccgttgtggacccagggatggttatgggaagcaaaacgtctcccttaatcataaacagtgtctaccagtggaagcccatcgaccgagggatcagaggcctctcagtagtattgtttattgcagttccttggcaacattgcagagaggcagtcaggttctgaaatacaactgaggttattggcaggctgaggccctggcacaggcaccttctagaatatcagctagtgtcttggctttcctctggggggatcccgttgctgttgtgttacagaaatggtagttgtttactccaacagtctggatgaccgcatagaggaactatttcaatagtgactgacatcattttttttttaacctcgtaaacctttcacagttcaggggccttggatcttattttgaagacaggtgcaaattggaaatagcatttgaatatgacccggcaaagcatgattgcttcttaagctcaagtatgagatctgttttgcaatcagcttgtccaagatggttatctcttcactgtcaaatcaaagtgctctgcatggtgtttagagattgggatggtgaggagagagcaagcctgggtatgtgcatgcatctgtttattctaggcttcgtgcctccaggagcttggaggtcagcttgtagtataataaaatagaaaactatacagccggggagaacagaagcagaatagaaggataaagtgttgttcatatctctcaggcaaattttacccaaattctgacgagcagttactgcacaagcaacaacaaagggacctagagtgtgttcattgccaattctgtccatttggctacataactactgtgaaccaatacaaaaagatatgtataaacatgaataggcgtttggtattcattccatgaaatgctcaggcattgacagcgcttcaggttttgtttgctttttaacacaggctttgaggatagcacaggtcaggaaggctagggcgttggagcaggtttctcagcggtccaggctctaaactaaagctgtccctctcaaaagaatggaaatgatttcagattgtattcagcagcacgaagcaatgattcctaaatagttaaaaatctagaaagaaacactaagaattgtattgggctttgtagaagagaccccagaattttaggatttgggatgtatccctgcagtcaggcccagtccccagtgcacctgcagatctttgacagctgctggttgagcttctgctaagaggtttccttccagggactccatgttcactgcctcacaaaggcaggccagcctcatgctttagacatccttgctcttaacaaatctttcgtgttctgctacgtcagcctctgtgtgacacccattggaccttctctctgtagcacaattgcataccttgctctgttcttgataagataggtctaggagtcatcgaagaggtgtgtctgttctagccagaacacctccaagtttcctgctgtcttccaggacttcattcccaggcccttgggcactgtggctgctctccctgcagctccctgtagcaccatgtccctctgaaatgacaagggtgccctctaggcatggaggaaaccagacgaaggactggggagctgcaccccacagcctagagctgtgcttcttcccgagcatctggatcacccaacacataatctttattttttattaagaagctttccaaatagtcacaaatagccaaggttatttgcttctttcatgactaattaccatctgtggggaatgtggatttctctgtaggttttaatttgctggtgagtgggccattgctaccatcccctcctggtgtggggaagtatagttactgaatgctgcctccagccagcacgggcattgcagggggactcacagccgccggtcttccccctggggaaacaacgtcaaggttcctaattagaaagggctttacacagagacatgtatctactgtttgaagattaaatctgtccatgaaatggaagacttgattttatatgaagtcatgaagagccaacaccacatagtaaaataccggctttgaaaaacacagaggtgttgcatatttctcggtgcttctgactggctgtgtggccttggttaaacctcagagcttctctggccttcggttgctccatctgtaaggcaaggtctgtctcgagaagtctgcggtacctgaatagatgttgaaatggctcctgtggcaactggtattgtgtagagatggttcagtgtccacaccttgcagttgtcacattaagctgtgaaggacgactgactctagcactcagtggtcctcagtggcaggtgatgttgacctcagacaagagttgctcaggagataggctttgcagttcacctcgacaagcgtttgtggagagctaggtctgctacctcctgtatcgttgcctgtgggtgatggtaaggctcttgggggtgtggaagatgcggggatgatgatgatgacgatgatgacgatgacgacgatgacagcgtcgtcgtcgtcctggtcctggaaggataaagtcttgtggagaagaggaggcaattctgacagtttggggttgcatcatcttcttcacagaagagatgaagttgtgtaggcaccctaagtatggattgtcacaaaaagagcactaggaagcggggcggggcggggcaggggtggggggttcctggcagtgggaatgctgggcaggcatggcagtagggagcacctgctgcaggtggggttggtgaggtttcctcgtgggacttaggctgcagagagatcaagacaggcctcagctgttgtattaggcatcctggactaattctttaagccctgttaaggtttctgaaccagagggtgattagagctgtgcttgaagttcttgttagccggagtatacagctgcattgagcaagatgttgtaaccaaaggagaggtggtggtgggccaggcaagcaggatcctgcacactcagggagctctgagggacggaaggagggtgccagaccttggacagatgtgagcctgggtggacagttcgcagtgggactccgaggaggccaagggcatgggtgacagcaggcagactgctcgggtggaatgggcatcagctgcagggaagccgggggaagaacagggcacaaatcagagttcagtgtgagacgcagtgagtttgtgggtagcccagtaactgggaacttggaatggagcagttgggccgggagggccagggtgggagccgtgccgtgagaactggctgcctgcaagccgctgacacagccaggaagggcacgtggggcaagaggagaagtgggtctgggagggagccacatcctcaggccatttcccagaccagcctgcagtcagcaaaagcagagagctagtcatttcttcttattttatttttaattttttgttgttggagagctagtcatttcttgtaccaagctgcatttcagatgtgtgggtactactgccactggcatctgaggcatgctgcctgtatggctgggctggttgtggaaggcagagcttcccgcacaaagctgatggagagccccttctcccctgggcccaggcctctctaaactgcacttttggcctctgggtgtcttgtacaacatgaagacgacagcatttcttggtcacttgtaattaaaaaggaccttgggttggtctgtcctctgattgctaagattctatttctgtctaacatctacttttagtatcaatttgtacaaaaatctttgattcaccgaaagtagctgaagcagcgaataaaacgttctcatacagtcaggagcactgtgggcttgggcacaaggtcaaggtcccaagagctcttggttggaaatctcctgccccaggtttttccatgtggcttgaccagcacctgcagcccaggacaggtccagctagaatccctgctccccaccctgctcccgcccctacttggtgatgagtagcctattttactccaccaaagtgaaccacatggaaaggcacacaggtcagggagaatttgtgaattacggaatttgccctgggagggcacatttgttttgcagattccagcattgtcttttttaacattctgtctgaaagttgtgtgtgtactctctgttttgttttccagtggtttgatcttctaaactggcaaagctgcatgcatatggcagaattgctcactacaaagttattcctcagccaacttctctgcttaaggattctttgtccatgataccccctcccagccagtgcagcccaccctggtccccccacctgtgacacagaggccctgcaggccagcagctccccagctctgttgtgggtgggggagcagcaggagttctcttctcccttggcccaactggacctcaagatccctatagatcttctaaacattccaggtcccaggccctcaccccagaccaatcaaatcagagtttctattgggtgcccagccctctgtttaaaaacctccccaggagattctcctgtgcagccggcagtgagaaccacctgggtagaggtttccaaaattgtctgattgtaaaaatcacctgaggagcttggtaaagcttgactgtcccaggcctcatttgaggctactaagtcaatgtccaggctggggcttggacaagaatgtcattctttttgggtcaaagccaggttaggtgataccgccttgccagataaatggccgggactaggtagatgctgaacccagtatgctctgcgttcaaagcacagatcaggggcttcctgaccgtgcaagggatgccggaagcgccctcaccaccttccttagctccaccaccggggctgaatttagtttacggggaacattagcagcaacagagggaggatgatatcccgcacttagcccagggcctggctcgctgtctgacaagcactgtcaccatagtaaggacagtttatctgctcgggatgtaagaagtgctggaaaggagggggcagcattgttcagtccatccctttccaagctcctcacagtttttttctccctgtaggtccttcggggtcgtcctctgggagatcgccacactggccgagcagccctaccagggcttgtccaacgagcaagtccttcgcttcgtcatggagggcggccttctggacaagccagacaactgtcctgacatgctgtacgtacttcctgggccctccgtgctcttctgagttctcttctcaaatacctgttttcttgggtcacaggagattaggagattaaagccattctctctggtcctgcacctcccttgccaggcgtggctaagaggtttgtccttgtggaaggagctgagtgggttggtcgacctgtgcttttccgtgggtaccttaattctaccccatattccgtaatgctttcgttccgatttgcagttcacactgtagtttctcaggccaaatgtctctgtgaaatgtttggccagagtaatccatccttactcatcctctccatgtgaggtttttgtttctttttaaagaaggctacaacacaacacatactactctgaagtcgaattcaagagccccgcgccccacctgtggcaggcctgagggagccgccgcagtgagtgtgcacacagctgcatggccaggactccggcatgcaccacgtagggtcagcttggtgtcttctgaaccctgccccacatgtcttctctgttaagtgtttacaaaagtcataaaccatctaagtaacatgctctccggagcttcatccgctgaccaatgtggacctggagcgtgtgtgagctgacatccctgcggacagaaggatgccagtgctggtgaatttgtcttctcactgcacttttttttttttttttttgagatggagtctcgctctgtcgcccaggctggagtgcattggcgtgatcttggctcactgcaacctctgcctcccgggttcaagcaattctcctgcctcaccctccaaaatagctaggattacaggcacccaccaccactcccagctaatttttagtagagatggggttttaccatattggccaggctggtcttgaactcctgacctcagatgatctccccgcctcagcctcccaaagtgctgggattacaggcatgagccatcgcacctggcaaccccacttattttgaaaaaacactttgcagcttttagtcctaagttttgtcagatgacgagagagagtttgtgatgcctcacagtgttggtgaggcctctctgctcagcgccccctggagaagccccccttttggtggaggacttgctctgtgtccgtggacggtgctgttttgtggctcagtggaggtcagagctgctggagcagggaggccttgttgtccttcctggaatgagtttgaggagggggtgaaggtgttccagttcagtcatcaggcgcacaacaggtacaggttgggagcagtggccttgcttttgacatgcactttaaggcaggcttcagagattgatctggatctccatagctgaacaggaaggtgggctcccactagtatctcaagaccaattcaggagatttccagaaatgcttttcaggacaggtttggcttcattttggaaaggatcctgaggaattgctgggctgttatgtctgcatgaaggcacccagctcctatctctcacccatccacccccctggagccagcacagactcaggctgggcccacagtggcgggataatagatagatatgaaccagacatgtgtcaggtggacaggagggaatgagggctccagcagccacaaaagttttgctcatttggtctcctacagtgtctgtgggccaggaatccagatgcaggtgttcttgctctcagctcagagtcacaggaggcagaaatcaagatgtcagtggggctgcagtctcacctgaggctcagggacatcttcaggctccttcagggttctgcacttgcaggactgaggtccccatattcttggcacctgtcagctggggactgctttcaactcttggaggccaaggccactcacagtccttgccatatacagcctccataggccctctcataacagcagcctatttcttcaagactgataagaggacagctctctactgcttctactggttttttacctgataaagtcagatctacccaggatactctctcccttttaagtgattcacagtcaattgatgagaagcctgattagaggagtgaagtatcctctcatgttcacaagtcccacccgtactcaagtgaggggattatatgggatatttacaccaggggcaacgatcttggggggcatcttagaattccatagtctcagaaatcattgtccctaatcaaacaatcaaggtgctatttttgtttcaaagcactttgagtgttgctacaaatactgaatccctaagctccttgtaaatggccggccagcggagggcatggggtggggaagactggatacacacccctgtgctctgggagtacgttggctgggcggcatgctcattagctgctgcttccgaacataggttcagctgaagtgtatcccaggcagtggacacttcgtgtggaattcagaaaggtggcgcaggaaggataccagggaaagccagagtgaaggcatcacccttgcacagctagcacatgtgggggctcccattgtcccatcaaggcagggccagaaccagaaagtcggctggtgccctgggcctgggccagtgatgggaggctcctcttctctgagggtggcacctacagatgcagtggcactgggtttcctggagccctcatcaaggaaacttcccagcatggcctcttcagaactccacaatccaaacttggaagagactcgaaagaccacttagtaccttttcttgcccagtatagaaattcttcttctccccttctgtgttagttttttatcgcagtataacaaactacccaaaacctactagttaagagcaacagtaaacatgtattatctctcagaggtttctgaaggcgaggaacgcaggagcggcatagctggctggctctggcttggagcccttctcgcggttgcagcccagctgtccgccggggctgcagtcatctgaaggcttgcctgggggaggcagacccacttccaaggtgttgctgcataggtagtatgccctgcatgaatcgccctgttctacgtgggcctctccgtagcactgcccaagtgtctcaggatgtgtagctggcttctctgagtgcagagttcggcacactctttctctaaaaggccggctaaaaaaatgtttttggctctgtgggcccatacgaccttgactgtgactactggactctgccactgtggagcaaacacagctgtgggcgtcacataagctagcgtggctgtgttccaatacagctttatttttaatactggaatttgaattccacatcatccctgtgttgtcacaaaatattcttattttgaatttcttttagccatttacatgaaaaccattcttagctcatagaccttggaaaactaggcagcaggccagattttacccacaggtacatagtttgcctgctgtgccctagagtaaaagatccaggacctgagcagaaggcacgacgtcctttctgaccaaacctcagaagtcacactgaggctctcaccttctccttcaggttacaccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttcttgccagccattatgagaaaaatcatgctttcaagtctgaatataagccatggagtaagaggtctgatgaccactgaatctgcataaaggtacagtgctagaatctaggctaatactagaactggtggtattttagcaagcttagaaacagcccatgaaagcaggtgtgagttctgcttctgtggtttagggtgggtgagggagagcggtattgttctgtgctttctctttgactcgggtaaacgtttatctacaagagacttgtgggattcttacttggtccacctccaggtgactgggcttttactattaatgtaaactgcctgggacgcagcccctgccatgggaaacgcagggcacttcctgttctcagcatagagtgacaaggaaatttactcagagcggttactctgacattcaatgtttagttcaggaggcatttctgctttgccatcgagaatttttctcccttctaagaaaatgttttctcctgagaaaatttttctcccttccaagaaaagagtagaatgaaaggaggcaacttggtttcatagggagtgtcatgttgtccttctgagtttactgatgagcttacctgagaaaggagggttctagcatgggagttctgttgctacaagacatgaaagaatggcctccgtttatcccggagaggagagtccctgagcccttgggagttgccttgaaacctctgccgggtcccaggtgagaaagtgtgtgagttgtgtggttctgagatctgaacaggcaccatctggtgacactaggggctgaaggagctcggtggctgcaggtggactggagctcaccatcaggaagtagccagattctcacccctcagtgtcaccgagtgttctggctttagaggaaggactccgtggtccccaagccacaaggtgtcgaggtctgagtctcaacgccatgactcagtgtgaattaacttagcaggtatcacaacatcagatttgggttgtggttccctgctgggtctgtactttagattgatgacaaagcccgtcctcagccttatttcagcccagatctcggtatttatgccacagatactgttgagctcctctgggtgcgtgctgaccctgaggtcacacagatgagccaggagtggccctggctttcaggaaacgtagtgacgtaaaaggtcccggctgctgcgggataagggccagggcagaggtgtgaacgcagccgtggaagacttgggccaggaagccatttgttctgctgctaacacttccacagctccacgtgtccagactgttgccagagacgtctttggtctacaggattcaggagggaatctgaactttagcctggagcattatcaactcatagatgagtctgaaacaaacttagtgaaatctgatgttttttgtagttttccagtacagtttttcccatcgctggaatcctggtttggttctgcgggaatcgagtgcttgagtgggacccagacagacaggaagggcgctcctgctcagttagccccagtaagctcactgaggcacacaggccccatgtccacagccgctcctggctgaggcgtggttcctaagacgacccttactgttgagggctgccaggagggagagacacattcagccccgcaggtcctctgggaatccggtgagcgtcggcaccgggctggggccgtgctgattcccggcagcgtgtgggaatgtgcgggtgcctcgtggcctgctgacatcgcacacaggtcacagcctgtccagttcaggacatcagggccaagagtgaagtgagaatacggaggcacctctgtgtgctcaccctgctgaccgtcacccagcctccggggggggtcacagctggcccccaggaagctgcttcccagcagggcaggaattccatttgagtcttgtccctgttccaggagaagggctgggtatgtgtcccccaaaggggagagcattcgagaaggatggcgccagcctccccagaactgacctgtggttaaaaaaaaaaaaaaaaattgtgctttttaaaagatgagttttatcagctcacacatccttctagagtctaatggagattttttgtgtgtgtggaaatagtaaacaaggtcttgaatcccacagagcaaaaaagacttcctttcatgggcagcactggaagggttgttactctggaatggtttaaaagaggcgtcacatggcttgtttgtgctgatgtcactgcctcgctgctctcctgtggcacctcctcggtccctggccacagggcacagagccaagcacatctcatgctcttggcccagttacgcttctgcccaggggtaagtcagctggagaggaattcacagcccaggcatttcatgtcgttatggcctattttaatttttttaaccccaatcatttttcttaggaagtgatggggagtttggaaaggcaggcttatttgtcatcaagctgccagcttttatcaatgcaaaccacatccctgtgacatctgtgactgttccttggacagttaggtgagggagggtctcctggtggccccagggttactcttatttaggttgagaaaaattcctttttccaggatcgttggtgatcaaagtgtagtcattctgttgcgcagagaactccatcccagctccaccctcatgaattttgtaatcttggacaaattatttagtatcttagtgcttctgttccctcatctgtaacatgggggtatattatagtcagtagcacctgcttcacaaactcgtgaggacttcagcagttcacacacataactgcctcgctgcctggcacctagcgtgcacatggcattctaccgtggggtagacttttaaaattctggctacagagatacttttccataaaagtggccacatggaactctccaaatctaagaagcatactgtgggggccttcatattttgtctaattcttttctccccagaacaggaacctgcacccttccttcttttaaagggcgacgtggtaaataaacatttttagacttgcaggccacagtctctgtcctaatgtcctcagctggtagttgtagctggaaagcagctgcagcccacatggaaatgagggagcgtggccccatgccagtgcagctgatgtagaggcgggcagccccgggttaggccctgtggagacgcaggcccccgggctctagaacgctgaattctagtgaattctggatggctctccctcacacccaggcccaccctccctcaaggttgcaccttctccacctgaaggaagctgccaggtggccataggagcccttctcttggcaggccagcttccaggcccagtggcttctcttacatcaggggcctccccttggaatgttccctgaaggccagacacgggcaggtagtctgtggtcaagcagccaccctgacaggaggctagatgccactgggtgtgctttgagtttcctagatgtggagagttctgtgtggccacttttatggaaaagcatctctttagccagaattttaaaataaagaggataacttcctggtgagaacagacgtggaaaggaaggcactttggtttcacgctcatgtaagagagggctgttggcggtcactcctcagaactatggccagccctggatggtagccagctgctttttgccccaaaagtctgtttagctgggtctctgcattctggaagcttgtcaaagcccgggcctttcctgggtcagggcagccggctttccttgtccacgtgtggccggctgttttcttggggagccccggccacagccggcaggactccctttgctccatgtgactctgagggcctcacaggtatttgcagcccaggtgctgtcggagcccagccgatgctaccgacacacagcacaagcgtcatcctgttctgcctgtcccttgcgtgtggaggggactcgtgcccagggctctccttgctggcttgttggaatctggcttcaggtctacacggggcctctcgtttggtccagaacagcctggctcatcggctggggcttgcttgtgcagggctggagcgagcacgtgctagatggagacagcagactcggagtgtgcatttcttcgtgttgcaagcctggcctcacagtgccttcttcctttggttgtctgccaggggtagccctgcaccaggaggaagcttagaaatagcacaggtgggaaccggagagagagcactgttggggaagctgcggtcactcatcagccttcctggtgagaaaccaggggtttcctgctaattctggaaaggatgtttcagcagtgcctgcatgagacgcctcagatagaaaactggttatttttgtttcttagcactgccaccatagataacagctgtcacgatggacagtgtggacctggattagtccttcttgggaaaggagagtttgggttttgtaccgtggtggttctgggttctgggggaagagaatggaaccgtacgaggtaaaacaggagactctgaaggccacttggccatccaggcagaaagccagggatggagaggggcagcagggctgtgttcagtgctcccgccgtacgcttgtatgcgggaaaccactgcaggcggcccatgaagcctcctggccatgtgcgccctcccggtttggaccccctcccgtgtgtcttggctgcaggtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagtctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaggtattatatgtaggagttttcttttaatttattttgtgataaattaccagtttcaatcactgtagaaaagccccattatgaatttaaatttcaaggaaagggtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttctcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttctgagatgtcctgtttt

SEQ ID NO: 32 - DNA, 66524 bp, Human
ttccaattatgtggtcgattttagaataagttccatgtggtactgagaagaatgtatattctgttgatttgggttggagagttctgtagatgtctattaggtccacttgatacagagctgagttcaagccctgaatatccttgctaattttctgtctcattgatctctctaatattggtagtagaatgttaaagtctcccactattattgtgtgggagtctgagtatctttgtaagtctctaagaacttattttatgaatctgggtgctcctgtatagggtgcatatatatttagagtagttagctcttgttgaactgttccctttaccatcatgcaaggccttctttgtctttttttttatcttgttggtttaaagtctgttttgtcagagactaggattgcaacccatgctttttttttttttttttttctttccatttgcttggtaaattttcctccatccctttgttttgaacctatgtgtgtctttgcacatgaaatggatctcctgaatatagcacatcaatgggtcctgactttttattcaatttgccagtctgtgtcttttaattggggcatttagcccatttacatttaaggttagcattcttatgtgtgaatttgatccatcatcatgatgctatctggttattttgcacaacagttgatgcagtttctacatagtgccattggttttatattttggtgtgtttttgcagtggctggtactggtttttcctttccatatttagtgcttctttcaggagctcttgcaaggcagaccaaatggtaacaaaatctctcagcatttgcttgcccagaaatgattttatttcttcttcgcttatgaagcttagtttggctgaatattaaattctgggttgaaaattcttttctttaagaatgttgaatattggcctccaatctcttctagcttgtagagtttctgttgagaggtcttctgttagtctgaagggctttgctttgtaggttactttgcctttctctctggctgcccttaatattttttcattcatttcaaccttggagaatctgatgattatgtgtcttggggttgatcttctcatgaaatatcttagtggtgttctctgtatttcctgaatttgcatgttggccagtcttgctatgttggggaagttctcctggataaaggataggtaaattctatgggtaatacagtagatatagtgcaacaggaacttaccagttaagatacagtcataaccactcacccctagttggaatgtaggtttcacacaactcccactgatgaaaagaaatatatgtatttttcaactgtttaaccctttgttaagttttcttgtgtaaaattatctgcagagccatgaaaaaccatttgatatttgtgactaagcagcctgtttggatgattatgctcttcagtatgaatggtgagctgttaaatgacatgctcaatcattgctatggaagaaatttgttcttactagcaacttgaagcttaaagaaacatttataggaaagaaaattactcaaagctttaaataaggctacttttagagttggccttagactacctagagggcatgatgattaatctttcacaaattacagattttatttgttcatgtccagtgaggtgacttcttggtggacatcttcattgcaattttcagcagctctatcaatgacacatgttaactgaagctgacatgggttgctcttgctctcttggaatgtctttatttctgtcctaatatgcaaaggtagtgccagaatttcttaataggagggcctcaggtataacaatctagttgacaggaaaagcaatggaatcttcactgcatttgcatcacaagcatactgttttttcttacgtgtgttttttagggtgtcttgggatgttgatcctctttaagtcaaatagaaaaaatgaaaatgaaatgccatagccaatattagagatatattaattttagtctttgttgcttttatatttttctaggacaaagagatcttcaaaaatcaaaaatgaggttcacatttacaagccggtgcttggcactgtttcttcttctaaatgtaagtaaaacaaaagtattcaaagccatgctaatgaagaatgctgaataaggaggaatgttttgagtgtgatttaattagtatttgcaagggtaggcattggtctccagaagccgaaactaagttcctcaaagccattattttgcttaatattttgttaacaaatctctcctctgaactgtctctaatttaaattagtgtttgtggtctacccagaaatttgagttttgtttacaaaactttagcattaattttagacatctccatattatcttagaaattaacatagttggtaaataatattctcaggtaaaatgttttcatgttgaaaaaactatgttttgaatcttagttcaaaactatgatttgaatgatagtttctgggctgttcaatccttttaaaacatctgggctgttcaattcttttaaaacttctgaactctttcagtctggctattgatttcaaatgtatttttcatcaaaaactgactatggaaacttcaagtctttatataccactattattctataactctttctccaatcttttaaattatgttcagtttgtgtaattctatattgttttattcctaaaagatttagcaagtaatcggaaatataatcatcttagagaacactatcaatgcctattatttgtgtcaacattgttaacctaccatcacatcagcttcaatagcacatgaatgggagatgagtaaattttacgtaaatcaatgtggagctgccttgcttcttatcctttctgtcacatcagagtaacatttgctaataaattacagttggcagcaaagatcactcaatatctcatactgtcatactgacccacacaaagcttgcatagggttcgaggatttccattgtttattaatgtgtagttataggcctacaagtctgtctaaactgtttgtctttatattattcaagaaaaaaatattgctagtatttcataaatgttaatttaatttgtaaggcaatttttattttgtaatattgtacatcaaataaatggtgtatgggaatgactattaatgcaacccttttgcacctatttggataatgagtataacttattttattgtcagtttgtcttatcattttatcctattaaatatttctttagataaattacagtaaaattttctaaaagtaattagtatttggaaatgcaggtttctttatgtcactggaaatataataaaaacactaaacaagactactatggaaactaatagaatattttaatttgccagtaaatacccaggccttatgtggtcttctatggatgtaaaaatattgctatatattattgatattgttatttttcatagctcaaatgaaatcctaagtgatctggtatatgtgaatatttttgaataatcatgcttcataaataattatattgaacatgacagaagaaaaactaaagaaagaactaaatactaacaaaattgtttgaagattatctaattaccttttttattacaaaggctttagaaaatttgtagtgtgttcaaaaagcaacgtaggtcatttttattcaaaacttttactaatgtagtctataatttaaatattgaaaaaaatgcacatctttgcatgagccatggacagaaacattttatggcttgtgggcacctcttgaccagcaagcataactgaacagggcacttaaatgggtttgtgctctctttgctgtgacagagagaaatttgcttctctctctgtatttggattatatatttgatttggaggatttgtccataaaacaaaatttgatatgtccattttcttcaaaacgtttattatgttcacactgacacttctcagagaaaaaaaattttaatgacaatgttcctaattaatccgaaatattactttttagacaatagattgttgtgaaaatacactaactattgaactctatcaactcgatttccatataggttttaaagtctcagtttgggtcaccaccttcaattagcctctttccattaaccataaccacccactcaattcctctccctcctgcgaggtatacagtaagcttagagcagcagttggtatacagtgagctctcagaaaaagatgccagtgacgatgctgatgacaacaaagccaatggtaataacaaagacataaaaattaggttcttcagagcaggtgttattgttacttgtttacttatctatgttcacctatttgctttgaatttatgatatatgcagtttcgttgtttatataatgtaagtagaattacacagtacaccagccaggcatctgatcttacctgggaaaaccagggctaacactttttacaacagtgtgctttgtcctttcttattttgaaatgtgtaagtaactgaaaagcaaaaataattatatacattatcaacattaaggatggtgacatgaaaatctcattggttgcatcagtttgtggattctaggtttacatactttttagagtagttttgcatgtggcaatcaataggaagctctcccttcagcacagcagcttgggtccatacactcagtgggcttgaactattgcagagatggaccatttctcaaagttccatgaagaacagctctgtaactgtctctgtacttctagaaactgcctgtaacccaaaagcaaactgactgtcctacatcacagtaggaattgcataagcatatgaccatttcaaatcagattcctttcctgtggattccatgattagtgtggataaaatcaagaatgtaagctctatgagagcaggtggcttgccagtttggttcactgctgaatttccagaacctagaagagtgcctgacatgtgagaggcactcaaagtatttgtcgactgaaaaaaactgatgatgtttgggctgctgactactgctgttggtggcagcttggtggtcgtatgtgtgacgccatttacttgaacctttaggagtgacatcacatatacggcagctaaactgctacatgggacaacaattaagagttttgtttgtttgtatgttgaaaaatcatgtaagatggtttatatgcaaagctttgaaaactgatgtttattcagaaaaacaatatgcccttaatatctcatttctatctgaatgtgaacatataatcatatttttatttaaccccctgaaataagtagtatagacataacacttataataagtaggatatttgaagtctcttacattgtttggtagtttcatccaatcactactggttttattttgtctctgtattgctgaaaatgataccaccttcccagcaattcttatttgtataaaattatcagcaaaagtttaacatttaataaactttatgaaatttgtatatgtgttatttttaagcagtagtaattccatgattgtaattatatatatataatatacataaaatcatacatatacatatatttatatgtttatatctatctatctgtctgtctatctatctatctatctatctatctatctatctatctatctatctatacagtcagccctctgtatccatgggttgtacatccatagattgaaccaatcttggatagaaaatattcaggaaaaaattgtattgtaaacatacagactatttttctttttattatttcctaaataatacagtataacaactatttacatcatatttacattgtactaggtataaataatctggggatgatttaaataatacaggaggatgtacataggttatatgcaaatactacaccattttatatgaaggacctaagcatcctcagattttggtatccacatatgcaaatactacaccattttatatgaagtacctaagcatcctcagattttggtatccacaggaggtcctgcaaccaatcccctgagtataccaagggatgactgtatgtataaacgtaatgccccaatgggtatgttattttaggaagaaggccactgagacattcatctactgttgggaaaattccatcttcagtgctcaaatatgaaccagaccaggaactgatgcagattattactgctcatctgacaacagaggttctaatttttcattccttcagtgttgaaacaatctctactgaaccagcttcaaacaagttcactggagtttgtttcaatattgcaagaatgataagatggaagctactttcatcagcatgaattataactactcgtatacagattgtcgtatttccactgttactgatgttaaaactgcattaaagcaaataaaaatataattgaaaatacaagcatagggttttctacttgttatcctcggacatactatttgcctatggtttccatgaatttccaactagagcaagaaaatctcttggttggttgtcagccatataaaaagagaattcagaatgttacttttgggaagaaagccagatttaaacaaaatacttcccagtgtttagcatatctaatacaagtgacagataagatttatatatgacatcatgttccatcttctaattcgatttgaagatggtgagaaaatggtccagaaattaataatacatcaaatgatcattctcatattaactgaagattttagagccacaaaagaagaatctaaaataaatgtataagttgaaccaataattaatatctctattgtgaaggcatcatgatccattcttgttttgatggttgcctaatatgtaattgaatttttaaaacacacatattcatacaaaagttgagtaataaactaaaaaaagaaacctcaacatggaatcccttcaaattactcttttttaaaaattttgcaaatcgtgttccaattccattaggaatatctaagaattttatgactgatgattctttattgttcataatttcaagtatcagaaatatattttatagtgttggtccatcttgccagactgtaagctctatgagagcacagtctacacttattttattcagcactgtatcctcagcatctggcacaatgttgggctcatcaagtttgatcaatatttgctgactgatctgaagaccagtggggaaagtgtcatatatcaaaagaattgtgttcagctacactggtaaaggatttgcacagttataatcatttttatgggttcattactttctcttctgacataaattcaagagacattaaaattagaaatcaacaaaatgtttaaagagtagtgtcaaccttattcacaattggtgtccatttgaagttatcacagtaatgttataataatgataagtattcaccctcttctctttgcaagatatttccactaggatggcttgctaccatctccaaatctaacccaaaataggacttacttaccaagggggagaagttccccctaataaggttttcctttcccagcatcttccctttcttgggaactatttttttccccaaatatctaggctaattatctgggctatttgactattactgtttcccattccttgtattcaaatatgccttcatgtttttattattgagaaggtgctaagagtggtactttcttgttccaacatggactgatctagtccagccaggccttcaacttcctggctgcccccaccccaccccgcaactttaacctgtggacatctgatgcctgctgcatgaattttactaaaaattctcctttcacaaccttcactgatcaaaaatctacaaaacatctttatcatatatattatgttatataccatgttttaacaatattagctaaaatgttttgaacctttcatgtccctgacacttggtgtttattgtcttgttcatcctcacaacatgacagatgataaatattattcttaccgctcttcttattttacgtttcctaggttgaggaaacagatctagtgagaggttgctaacctgctcaaagtgacaaaacaagttttaactctttttttgttatctgaagattcagataatgcagtcttgaaagcaaagtcctgaccttcttaccctcaaatatgctccccttcaggcaagatggttttctcacagtggctcatgcatgtcatttccaacctccagacttttgtgggaaaggtccctccatcccaaaaggcttctcgacccccccttgtgcctatgcagaaacttcccacactcaagatacaattcaaattctaccttgtatctgtagccatcctgaatatttttgctccctactctctccaaactctgaattttgattggattctgtgctggacagcttagcagttagtgatgtgctgtcgtgtaggacatatacaatgacacacatggaaaacagtgaggattcaccatgaagagccaggaatatacatgtcaacttaatagggatgagttttgtttagaaactagcacatatagaagagtacataacaccacttctgccatcaatacaattggagaaacttcaatcttagaattgaaatttcaacgggtatgatagaaattaagcagcattcctaaatttagaaaaaggaaagtcagtgcaggctgatgtttttaggtctcctcaaaaaaagaaaaaaaaatctctatgcagaacatggatattaaaaattcgcagattccaacaccactaaaaacattggtcatagccacaaaagaaattgaaatctttataaacacaagttaggaagaacagtgtgacagagtgatcttttcaaacacccacattacctttgaaaaagagaggcttgtgatggtgatgattaactgaaactgaaaaaaactattgtcaatctgtaccaaaatgcaaatgtgctgagataaatatctaagaaatacattgatttttcattagtgaacatgaattgccctgtacaggtcatctgctgttgaaaccaatttaaggagattatggtcaattatgaggagcagaaaacatattttgtttgttccatggaatagatgggataaatttctggcagtgtacacagcaccaataaaatttagctgaaagaatcaaataaaaaagcatatttattgaactatgtctattttttaataacatgattcatgattcttaagagtaaggcaaagttgatttcatatttgtattttttggaaattagattatttgttttgtttacttctaaactttagaatcataatacagttaaaacaatcctagctgataaagaggtatatgagtgtgtaggtgttatccattttcaatagtaaatggaaactaatgcaaatgtaaaatgtgccagtagaatttgtagatgaaatgtgaaaacattttttgtaatatatatgaaaaaaactgtacatagagaccatgaataagtattgcttagagagcaaaaataaatgttttcaaactttttcattgtctcatttatttgtgctcacccattcctcctgtctataagtaactgatttttctttttaatacagcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtaaagagaaggatatatatgaacatatgtttgaaacaccattacagacattttcttttgtggttaaatatgtgttgaataattttaatttaatatgccagcagttttcacagcagttttcacactatggtatgtttgtgtatttcatgcagtgcatatgcctaatttctttgcccaagttcatctgactgcaatttggctaacatctgccctcatgataaaattaccgcaataattcagtattcacacctggtgagccggaacagtaaaggaccgagtgagggaggggatgtacaaaatgacaggaaagggaattggaaaatagagggcagagaatttgcctgaggtggaccctatcaaaccctatcttgcttggattaattaggtagtatcttccctttaactgtcaattggttggcaacccatactattcttccacactttctggccccactttccaggagaattacaaaaaggtacctcctagccagacattgtttatctaccagcttctctagaatggctgtatgtgactgcccagatattttcaggtctaaacatattctattagctgtagaggacccatagaaaaacaaaaggggagatgtgatgggcaagctcattgcaacatccctttaaattctcctacttgtcccctgaggcatttgaaaagattcaataagatcttttactatatatatatatatatttaagacagggtctcactctctcgcccaggaggatcctcccactttagcctcctgagcagttgggactacaggtgcatgccaccatgcccagcaaatttttgtatttttttgtagagatggggttttgccatgttgtccatgctggtctccaactcctgggctcaggagaggttcccaaagtgctaggattacaggcgtgagacactgcatctggcctactaccatgtacattttaagacaacccaacttggtagggaaaaaaatggtaaaatatactctgttactgcacattctttgctttcaaatagttcaagttttagtttgtagttcttatttttaccattttcctttaaacaaaaacatcaagtcaactgaaaggcagatacatattattcttctgtctgcagtaatttcagtgtttatcaagaactgaacaggcattagacataactctgaccaaaggagaaacaatttcgttgaagccagtgagacaataaaaacacagaactgatatttttggggttttctgagagctcttttcattttttaaataatttttgagagctttcttgaaagcctggatctgattcttttgaatacatacctttatagaagtaaatcttcatggttttaggtagaatttttttttttttttttttttttttttttttttttgagagagggtcttgcagtctttggggcatttgcttttttgatgcactcaactttggaaccttttacaaagtagaaatagaaccctgcttgtcatccaatgagataatttggtcacagatatgctaagcctatttgaaactttatttccaaaataaatgacttggcttgtttgaaatgtggttggttatgactggtgtagtgagctcagctacttgtaatatcgtcttgggatcaatcttctcatttagttaaatccacaaggcttcaatatcaatttccttctaaatggccaggtccatattgcaatcgcacctgggatggatggctgtgctgggatgacacaccggctggagtattgtcctatcagttctgcccagattattttccggattttgatccatcaggtagagtgtttattttcattttatgttcttgctatgaagcttttagagttttcatggttttgagaagaaaatcagatacaaaatgtacccacctaatcatactccacattttagcaacttctgaagtgtttccttaattgaaatacttcttagttgtacaaatattacaagctgtccttttttttaagtcatgttgctggtcagttatatgtgttggtattaaattctggtttataaaaatagcttttctaaaactctgtgaatagttttatttaaatgtgagttttaaaaatttttcaattgtctcactgaaaaaggggtagaaatcttaattatgaaggagacccagatgctgaaactaaatggattagctatgggcacaacatataggtccctgttaatgggtgaaatttgttcccaagagtaaagtgagcctgagcctacaggggttaagtggctctagaatcccaattaaagaagaaaaatgagtctacccctgaaacaatgttagaaaaatgctttttgtgcttccttccagagtgaaagatctaatctgtccctgaaaacaaaatttcacctcagtaaggcagagataatggaagtggaattgcagaggacctcttttaaaaccaatgcaggccagccacttctgggaattcccattgtgatggaaaagttgggatgtgaagaaagaaagggctttgtgctgtgccctaaatcagctacattcctggaatctctaactaaatgctatttgatgataatccttcaggcccttattgactcttcccaatgaatgatgcttcattaatcttgatttgacaactacattagaagttacttgattggcacgaagagctgttgtgcaattgaggctactaggccagttccaaagtaacaatggggctcttgccaaagtggatataaatagtgactacaaggcaaggttttgataaaaaaatcagagatttacaggcatcgatccatcttttcagcctggttcttatacagaaacctctcagctgcaggataaattcattttaaaagtgtatctgaaatatatacatatattccaaacttaaattataaacatatacataacataatatatatatacacatacacacacataccaaacttaaattcttcaggattttcttattgacctaaagcttacatcttaatgatgtacaaaacacattaatgaaatgccagaggtttgtttcactttggaaaaagtacttggtaaaagatagtgaaagagtgaagaactgtattgaaattcaaaagaggctgacattctgaaggaatatgctggaatgtaaaaagcaaaatttaacaaggaagcatttacagccctgcacttgaagacaaacaaacaattttaatggcacagagccattaaatggtccaaatatggtttgggacggtgattctcaacccagatgccctttcacaaaatgaaaaaaaaaattgtgagcttatgaaaaatgcagatgcctgacccctgtccagatcaatagaatttgaatctctagggacaggacctcggaatctgcaagtagttcccctgcgtgaatctggagtgagagaagcacattgtacttttcatgggtcagtccacacatagagtattttagagagaaatatcaattatcaaagcacatgtggagagtctccaggctgttagcggaaaatctgtggggagtgaataatgggggtgtttggtttctaaagggaagtcccagagtaaacataatcctttcttcaagtattgaaagactcatcaggtgaagtaggacaaattcttgatagttataacagttaaaaccaagaaatgactcgatccagactttagttaaaacaaaacaaaaaataccatttgctatggccttgttcatgagtggaatgaccttctttaagagtagtatctctctgcatacaatatattttcccatacctggctgcataacttcattgaaaccaaattacattcattttatttaaaaaaaaaaaactactttctgcaatctaataaatataaattgtggccacttttaaaaattgcaagtaagcttggaagggttgtcattgacaaataacattagcaaaataatcgacaaattttcaacatcaattttttgtgctgattagtgctaatcctttttcacatgttgttaatgtccaatagagatgctttaaatagggtttgtctagtggctatctcagtaaatttacagttttaagttttcttatttaactttgtaacagatttacatgaagcagtaatgattctaataggttgcttgaaaacatcttttgcttgaaaaaatgttttttcatccattttaaataaaaattaaacatacaaataactctataacctgcagtttaaatcttgcatttagttcaataagacctgtttcggtcatacaataaaaaatgatgaattatacctaaaaattgccaagttgaaaggacttttttactagctcttagcagattgagtaaccaaaactagtaatagaaaattattttaaatattatcagatctcagtgatttttcagccaaataagtttctcttttctttagtatgttatttccttagccttttaaacaatagcagtgttcttcaaatattaccatatgattctgatttccacatcctgtgctaaaaaagaacatagccatctataaaagcattatctatacgtacaacaatgctttgcctttgttaacatagaaaaatgcttcaaaaatattttccctgagaaatgatcaaagattaaaattttgtgaagattccaaatacacttgcaaaatctccctgcatattataccaatctaggcttgctatttgatctctcagacaataaacacatcgaatgggtgctttgaagaactggagagtatctgaataactcagattaaatttggcaagtacattcattttagtgtttacttgttcattatttctatgttatttaattcaacctgattttttctttcagttgcttggccaattcagaggttagaatttaaatattatcttgtagctaacaacattatctaaaattctttaggtcactggaatggaatgtagataaccttgatcatttatgagatttcaccttctagagtcccagtaccaaattaaaatattgttgaccagtattataatacaaaagcgaggttttttttagacaatccagccaaattctaattttatttcagtgccattttagttgtttgctaacaattatactagttttacagtgtgtttatcctgctgataatagtgtcttgataaatattatctcaccattctgaccactttttactcccaatatatattgatgtgatttcccagcctcatgcactttacccagaatctcagatatatactcagttaataattaagcaaaatacagaacaaagaagttttcttatttatttttaagatggagcacttgatgtagggtctggtatattttaagttatcaaatgttattttaaaaaattattgtagttgctatggtggcctaatattttagtgtgaatttcagcaaagatatgagtcatccccatgagaacttattatttctatcaagtttggaactttactttgtactgatacatatacactgcctaaaaaaattaaaataaaaaaagcagcaaggctttatcatactgtaaccagcactgaatatatcacacaaaaataattgaaaaaataataagcctgatgggaaccagcagacaccacaaagcaagcacttggaaaaagttctttctcagggctcaaagaaaatcttcttatccttttcctccaaaatattttagtgtaagctgaactcttaagctcagtgggcagccccagaatcactgacctgctggttggagggatagtaagatgtcaggctttcctcctctttgctaagcatcaatttcaaaaaaaaaaaaaaaaaggggggggggccaaaccagtgttaccttttatttctatgccaaatccaacttccaggtaccatttacatcatcttattttctcacctacatctgcatcttaacaataagggcttgcctgttttgtttcctctgaccagttggcacattgccacagaaataagaggcttaattagtgcttaatagctctgcaatagatttggaatcaagtagactcggatttgattcctgacctttctacctgctagttatggaagggaaatttacttatatataaaatgggaagaacaatattcacttcaaagactcattattaacgttaaagaagataattctgcaaagtgctgagcacagtgcctggcacccccatagcgaaggtggagatctttaatatgccaatccagctgagttagggatttcattaactagcatctatgagatactttaaaaagtcaacattaaaggctgaagcctggatccctatatattttctgtgggatgaagagagatgattcaaatgaaatctcttgagaggcagaaaaatggcctcttgatatatcccttagttttggacttctttgttctattggatttaaccatatgggattgggaagatttgaacatttgatccaaaaattactgtttcatacagttaatctaatgaaaaaacattgcaagtaaataaagaaaggtatgttcttgttcttctctagtagtttccatctataatcaaaagtttaatgtctgttaaaaaattatgaggtagagtataggtagcactttggagtctgaccgatatccatgtctttgggtctaaatcctggttcaatctcaagctccatgactcctctcactgtctgctttgaatttgtaaaatgaagatggcaatgcctacttcacatggctttgctaaggataaaatgagacaatacatattaatacactttgtataatacatgatttgtgatagtctctactgacatactcacattcaagttctataaagtgattaatatgttggaatggcttttaagctttaatttattatttttccttgttgggattttgagatattaatgcaataactgttatgtttcattaacagaaaaggttacaaaatactgtgatgaaaaaggtgtttggtttaaacatcctgaaaacaatcgaacctggtccaactatactatgtgcaatgctttcactcctgagaaactgaaggtaggttctttttcacgtttcagtattgagtgagaatgtcattatttgtacaaggaaatggacgcataactgtaaaatatctgccacaaagaagccaacaggttttgtggaaagaaatcatatgataactggtaagttctaggaatctctagagtagaattagagaaaatgacatttcacttcttggttggcactcagagtcaagagtcaattgaagttccgtgagcatacagaatcagtccatttatggcagggggataagtgtccatagagcagatgaaaggattcccaatgatgccagaaattaggcaacatttcaagggactctctaacatctcttttcctggaagagtttcaaaactacagatttttccacaagtcacaagatagcatgcttcccctgtgttagccacaaccttagttttgtaataaagcatagaaagaactcctaaagtagggcatctcatcagtccactaatacagatatggctgcttagattattttcagtggaagttcattctcaattgttagtacttgcattttactgtatgttaaatattttgaatattatctctgcttagaaacatttatctaagcaaatggcgggtggggaacagatgatctttcttcctcaaatgtatcaaaaatctgaaaaattcaccaagtctacaaccagcctcctcaccctacagaacaaggagttacagttggtcaatgtttagctgtgcagggcgtctctaagcaaccctgctgactctaacataaacctattatttctgtcaaagataggcctgtatactaaataattattcagttgaaaactaaaagcacattagtgtctttgtttgctgttgagatgctttcagggtgtagaaaagttttcttttattaaaaacaaaacaaataacaaaaacaaacgagatgaacatatggcttagggaccacttgaataggagggacacctcatcacaagcacaagctaagggcaccacagccagttatctctttacaaatggtttagtcaccctgagaatcagatgcatgtctacaccctaatggagagctgttaataaagtctgattaataagctatgtcacagagtagtgaattttccgaatgagtgttgattatgatgttacagagaaaaattatactcatgttaaccagattgttgtaagtagtgcaagtccaaatcattcttagtgttgtttttggacttctcacgtacactggccacatctaagaatgaaataatttaaagaagaaatgctactctctaggcacttagtataatgattaaaatgcttttcacattctcagtaaactatcgcaagaacaaaaaaccaaacaccgcatattctcactcataggtgggaattgaacaatgagaacacatggacacaggaaggggaacatcacactctggggactgttgtggggtggggggaggggtgagggatagcattgggagatatacctaatgctagatgacaagttagtgggtgcagcgcaccagcatgtcacatgtgtacatatgtaactaacctgcacattgtgcacatgtaccctaaaacttaaagtataataattaacaataaaataaaataaaatattgaaaaaataaaaataaaaataaaaaaataaaatgctttccacaaatcttccatataaatatagtcacattaaaatttgaaggaaccaacctagaattcattaaaaaaaaagtcaaccttgagaatgacacaaggatggcaactaaattatgagttgttgatttaatcttacacatttagacaactctatttcagaagaacaaatgtttttaaaaggagtactctggaagcaactgaaaagaatatgaattaagttatataaatttttcttagaaataaagtatgcaaagattttttaaaagaccgacagaagagggggtgcagatacatatccaaattaattaaggggcaagagtgttctacatagtaaactatttagaaggaagaacttttagaaaatgctcctcctgatattgtctacaagtgaagttagaaaaatagccagaaaatgaattcctgggagaaaagataggtgagtgtgtgtgtgtgtgtgtgtgtgtgtataagattcctaaatccctcccaagaaagctacctgaagattttatcagctccaattataaaccaactattctaactttattaacatttcctgtaagagtaaaatgtgctattaagagagtggtatcaacaatgaaaatgccccaaaaatatggaatgcctggtcaaatgatgcaacaggcacaacttaggagaagctaattagtccattttgaaattctaaggcctagaaaaggaatgttcatttcaggataacataatgcacataaccaagaaagggctctgaatagtttggatgcattttagctgactagggcttcaatcccagactctttctgaggaaattgacaagaatcaaaatgttcaaggatatataaattctacatttattccaggaattcaaagaacttcatagaaggtattcatcctatctacactacatttgcattcataccaagacccaacaaactgttgaaggaacttaagaccaaaagccaagagattaaagtacaactacaaaataatacacaaattatgcttcaccaagaaaaacaagtgaaaacaaaatccctagttgcaaaagattcaagtctacttcaattacagctgatgaaattggctaaatagtacaaaatgcaaaagctagtgtcaaaatagagtgaaagagagagaaagagagagagagagaccagaaacacagaaacagataaagagaaacagagagacagagaagacagagagagggatgggtgactggatcaatctctattttctctgttgataaaattacattataaggaaaggaaagactgtgattactaggaaaaaagatgctatgacattatgcattttatgagaaggacattcttccgagtcaacataacattatgggagaataaataaaattaaccatgatcgtgaaaaaaaaaaagaattatcaaatggctgccaaggggaaaggtttcggcttcaaccaactaaatactaatgatatcattttaaacaaaggcacagaaacctgccaccatactctctggaccctctgtaggtcaggacagcttggaaagtcgattactgctttgccagttctgtggtatagaattatgtatccactgtctaaaagattccagaagttaaaaaactaccaggattgcttactgggcttagggatgataatttttaatgcatttaaagctacttctgaaatatatttttgaatgaggtacttcatctcaaggaactttattctttgaaaatgacaatttattttcataaaatgacatgagtaaagctaaaaattaatttcactatctgaaatatttgttataattgtagtaggtttttaaaaggaggaaaacatttgttgatttacatatatttagaaatagaaatgattttctctctgatgaatcattcattcattgtttgtttgtttactttttgttgttccagaatgcatatgttctgtactatttggctattgtgggtcattctttgtcaattttcaccctagtgatttccctggggattttcgtgtttttcaggtaagtacactcacagcatctgctctttatttcctcctttaagttactgaaacgaatggtgaattctgcaagagtggaggtggggaagggtcttcagcaaattacaagcgacatgcaacattaggagtcatgaagtagcaagaaaaatgaaatgaatttaaatatgcttttaatcctatctttggggagaacaggataaatttatatcattttcaaaagtactatatcttgagacttcccaaaataagacagtcctgtgaatccataagtatactgttgtaatatggtaaaggttccatttaccatgggtaagttaccattaagggtggtggagaggattctccaccttcttttactcccactctaatttttggagaccatagccacaaatccatatataccctgcctaattatttcttgctagcatatgtaagactaaggaataaacaagcacatcagagcatgtttctacaaaacctaatttaaataatgcttgtctttaggttttatggtgcacaattatgcttgaaagcaaaatatgagaaaacatacaaggaaaacttgaatactttaaattatcttgtcatcttacatgaatataaaataggatctttacaggaatggtacatttaagttagaaactgttacatatgctttcatcacaaccaactttagtgaaaataaagcactcataacattgtcctaagctggatttctcaagtatgttcacaaatgtagattcagagtaaactgtatgtgtattttttttttagacacaccacggttcagtaaaaatgttagaaactgaagtaaattaggtaaaaatgaaataatacatgtaaggtgcctggattcatgtctgacacataataagtgaaatatgtgtttgatatcattattattattattattggtagtaataatagtcatggtggtatcacagaaatgataaagaaaagcccttttgtagactcagatgaccaacaatcatccacacttaaaaaatgtggtatgtgattaaatgtacagtgattcacatatagaatgaggggggagaagaatatatatgcatttatcactactgaactatatgtttaaaatggtaaagatggtacattatacatctatactttaccgcaaaaaataaatttaaaacatagtagaatcttaatttgatttttgttaaaatattgtcaggatagtactaaggaaaattaaaccaaggggagaataatcacctgtaaatacatccttagtacaagtactatttttttccttcatcatttttcaatctttgtctatatcttagtcaagattcttatattgactaagcaatagaggtgaacagcaatttttaactggatagcaaatgataacataagcaaacagacaatgagctccttccataaatggtttaacaggagaaagactgataaagcaaaaagacatgaagtattaattactcaaattagaatagaagagtattttcaatgataatgatcagaatacagtaatcacataacatgattaatcttggaatgtcttcatttttcaattgcacttcattatggtaaataaacacatcatcatggttctcaaacaacttttattttaaaatatgccactaaagcatattttttaagttttttaaatataatcataaaaaaattgaaagaaaaattccccaaatttgtaatcatgcaactaattgtagtcaggactttaaaggtaataatgtcaaaggcatagatcttaattctttatttctccagtcacttaaataagtgaggagatgtgagagccaaatcagcaaagaaattaagaatttttttttcaacgatcatttctatattaagctactgaagatgggtgtgttaaagtgtggcacaagggcaaagtagaatatttctcaactccagttagtcccaaagcaaaatgattctgatcaaacccttgagagagtgtgggggcagattgtctagaaagtacccaactttgccctaccgtctctcagttctaagaaccaactaaacagcaacttaaatctggggaagaaaaacaagtcttattgatttatcatctgagcctaataatgagaagaaatgaactgaaatagctggttcttcagagcagacacaacaagagacaaatgagatatgaaaagcacatatgctgagatgccaaatattcaaaccaaaaaaagctgtataaaatttttatacttgttttcaatcatatcttaaaccttacccaaactaaaaatataaagggcatctgtcttcttaaaatttaagtatgatcctaaccctttaatgttttttatatttgaatttcagaaacattaaaagtgattgtggaagtagaaaataatactgatctatcattggaatttatttgtgaattagcaaattttttccagaattttttttcaaatactctacatcaccatcacctttaagatctttactgcacattacaataggtttcataatttatgcacttaaatgggatcatctgtgtgcaacctgagcaaaaaatatcatcactcccttacttaattctatattcgcagggttgagtaattttgcaaactccaaacaattttataaaactttcaggaaaccagagtgaaaagttacccagctccacttctgagagctgacgccccattcacaatcattccattgaaatctcactgtaaagccctcagaactcctcaaatgtgtctcataaaaaggaggaaccctgcagctgtcctcctcaaatgagcaggcctcctaggaggcctgcagagaaatttaaagtcactgatcatacaagaggctttggaactgccaatacttcactaaaaacttgggatattactcagaattagtttattaaagcatgcctttaatcttaatgtaattttattctgagcatgcaggggaaggtaaaaggtggaattatgtaaacttaagcaaatagaaatcatgctccttgtgctgttggaaaattaatgtataaatgtacataaagtcttcagtttaatagcagaaaatttatcttctatgcattcttcctagagaaagacaaaatgtagaaaaaacaagatttttcaggtttaattcatggaaaagtcagcattaacaatcttaactgttcaaaagtttgaataatagtcaagatgatatgcaggtcatttctggtacaccagttaaagatagaagacagcattattaggatggtatttagtttaaaaccttcgcagaaaaaattggaatgatattatggaaagggattaaatataaacatcaaattagttcagcaagatttcttactgctagattccaatagtaagtgtcaacaagagagctaaaatgaagatacccttagggaagactggtttgggaaagacacataaatggacatttatttcagtttgattcttgaccattttcagcaaatttccaataaatttacttatccataaatttcaattacaatttatcaatttacttttctgtggaataatcctaaatatgtaagcctctcattgtatcacttcatgaaaagcataacagaccattcattagcatttattttgactcattgttatccatgtctttctgattggtattttaaatattattcttgcctgaaagctgatagaaatataggttggaaaacagatggtctcttcattttattgtctacattacgttacattggccacattgacaaaaagcatatataggtaatcatggaggtcaacaaaagtggcttccagtggaacatactgagggaagactgattgctctactacttactattctctttgttctacgtcatctctacatattgggtgggtatgtgaatctgtaccttgtgtagtatccaccattatacatctctagctgccttcctgttgctccaaggaaaccatgaaatcaatggtatcaaagatggcctcctttcttccaactcaccactggcaggacagacaccaaagataactgttgatcataccacggcatattcttcacccatagaacagtagtaataggaaaagcaagaattttgattgaaagagaatttattaatgataaggattttgtgctaaatcaaaaggcataaagtctcttgtcaaatagggaagatatataatatattgtatttgaattttcccaggagttttaatgcaatccattttacttcattttctctctttttttcagttctcatgtttatcatgaataacacgtgatcctaggtaaatgaaaactaaaagttacactagaagatatgacttgggcttgtaccaattacagaaatgattcctaattcatattttcccatgcaccagtaacttcaaaacaacttttacttgttttctttttgctactttgtttgctttgaatgtgactataattacactgtcttacataggagatatacaggagaaaatactgctgtttctcaccctgtgatagcaaactgatttagtcaactggcaaaactcaagaccaatatcaaatgccgtctcatacaactacaagctcccaaaaagtacacactcacacacacgtagggtactaataacttgaaacaaatgtgaaagatttacaccagatgaactataaccatgaaaatgactttttgctttagccttaaaatgtgacatcttgagattcatactcaagtaaatcattatctctttctcacatttgaatgacaccttgattggtagattatgttgtagaagtaaattatgttgtctcatcctcctactactggagaatttatggtacttatggtttcccatcactcaaataataagcaatgttctgtccatctaaatgtctgtttttttcataaagggaatagaatatagccagtgtcaagttagtgctatttctacctaagacatctcagatctgacaaaaaaatgttgtcggcttctctcatgttcatttaagcgacgtatttgtactgaggatttttaatgttaatttcaattaattctctctagcatcccacacctcttcttcagaacaattatcacagtaaaattaaattaaaaatggcatagtatataagggccctgaaggcaagagcgcctgtttgtcctctgttatattcctgatatctaccaggtctggatcataatgagtgcacaatcatatattttggattattgaatgaattttgaaaaatttgcaataccttcgactcacttcaaaaagatgactgtaaatgtcatcaagttagtataatacaaattttaaaactcaatgagcaaaaattatattaaaactttcaaaaaacagaaactcatatattagtcatacttctcctttggaggctagcagtttatctagttttaaactatcattttctctgtgtttccaatgaaaaatatatatatttttatatagagagatacagtactctttatatgtactgtatctatctaaatatatatatactgtttatatgcatatatgctgtatgatatattcatttttaactagtgttgaacaacaggataatgttccatgttagctagttaatacgaaactgaagaatttggcaaatgttcagtatgatatgaagtataaagtaggaaatcatctagcatttaatgtaattctttggtgtactggaaaattgcttagtggtcacagctcaaaacagaacatttttcttaaatacatttttaaatttaaaaaaaaatgggtattaagcccaatgatgtgtcagagagtgttctagatgtataaaataaattcctttagcactttcattttagtgggaggaaaggagagaataacaggcaataaataaatatatactgtgtcagcaggtgataagtgttaagaagaaaagtagagcaggcacacaaaagagtaagctggaggtagaggaagtatattttattcagggtggcttgggtttacacaagagaatgaagttaatgaagtcatttaagctaatgtacaacagcagattattgaacactccccaatcaaaagaaaaccaggcttaagaatatcattgctgtatgatacattcattcatactccttagttctagataatgtcaattatcattggtctaagccaggctgaattaaacaatgaatcccataattaactgctagtgagaattataaattgctgttgtgactatgaaggatggcaggtcacagattcaactgtgctgattgcagcagtcaccagatggaagtttattcagtataaacgagcatgaggtttcacataagtaatttttttgtttaaatttaaatttgcaacctacctttagtgctattataaaaccagttgggtttgatttatttaacagacttctgtactgctgaatagagtagtccacagaagcgtgtgtgtaagagaaagctcttctctaaatcctgtctttatcagagcctgcctcatggatgtaaattctacatcctatacctgtttaacaagttaaatttttaaaaatattatttattaatgagttactataatcgcttcccgaaaagttgaaaactgtaactataatagttaaaatatgctctaacagctgcctttattacttaaattgctttttattgcagaaaattgacaactatttttcctttgaattggaaatataggaaggcattgtaagtaaacccaggctatttttgtatttcatctttccccagaatttccttttcaaaattcttcatttctaactttattccatgaagatatttttaggaatagttagtgttatgagtcattggcatgttttacgctctcacatggtgaatgacattatactaatattttttgccttatcaaatatgataaatataagattttcatttgtctagaataatcaccgcaattttgttatagccatgatgtaggctctctctattgcatcaaaaaatgaaataggatattcaaattaatgtttatttatgtgaacattcacaccaacacatatgtacaactttatgaactggagagaaaagaataaaagccccaataaattgcttaatacacaaaaggtggggaatgactctaccaagaagcagcagcacttggatagctctcattggatccaaatcacagtatgcctcataatgagatttcatttgagcctattaagaattctctgcctgtgtctgagctccaccatcaggagggttggaaaagaggaactacagtgatgattctagttgaaatataagatctaagaagatggtaacagaaatgatggaagaggaggatgccaggagacgtgaagtgtgtgtatgcaatggctcaaggacatagattcagtaccttgtcacaggcagccttggttctgacttcacgctctgtgacctcactggccacatattttcttcctggttgcaacaatgaacagtaggcttttcatttgaagcacactgcagaccctaatagttgctaatctaagagtccttctgttaactaattttacaacatttgttataattaaaagagattttatcacccactctttcagttattttatgaagtcaccctgaggactgaaaactatgacctgctatgtttggaaacatgttttttaaaatcaggcagaaaagtaggaataaatctgaaagaggagaccagccttactttcttctatatgttctttcatcttttttttaaagaaaatatgaaaaatattaccaaaatgtttttttccaggtactccaacattttggcactggttaatgctttatgttactttttcttccaggagccttggctgccaaagggtaaccctgcacaagaacatgtttcttacttacattctgaattctatgattatcatcatccacctggttgaagtagtacccaatggagagctcgtgcgaagggacccggtaagtactgcatagttttgtttttacttttattttaaaggatatagtacctgtaaatagtgaacatggtgttcatgttggacttaagcagctgtttacatgtgtaatcatatttacttctaccgtcgagttttgcattttgtgaggcatatcatttctatgtagtttctgtaagaaattatagcagataagaatcatacaacaaaccatatatatatatatatatacatatatatatatatatatatttttttttttttttttttagatagagtctcactctgttgcccaggctggagtgcagtggtgggatctcagctcactgcaacctccgcctcccgggttcaagcaattctcctgcctcagcctcctgagtagctgggattacaggcatgcgacaccatgcccggctaatttttttgtatttttagtagaaacggggtttcaccatattggccaggctgatcttgaactcctgacttcgtgatctgcctgcctcggcctcccaaaatgctgggattacaggtgtgagccaccacacccggcccaaaccatgcatttctaagactaaccagtaatttattaacatttatgacaaatgtattgagcacctcttgtgaacatagatgatactaggtacactaaggcagtgcttccccgtgattctagtgtgccacaaatggttacaggtgtgcctagatattgatcccctcttcattctgttgccaagttgggcttggcccagtcatctctcctatgagtagctattcccttttgctaatgaaccatataaatatgatcatgttttgtgtcattatgctttggaaaaggtttataatgacacaggaaatgcaaaagttagggcaacaggacatacatctctgaaactcatgcccacatgcacaattgcaacaagcaaatatggtgactgtcctccttctatttgagtactatagagaacaggagagctgaaatcatttagctccattactgagaaccattctggatttttcctaccagaattgtcctgagagttgttcagaataacccatatttgtcatcagtcttctctctttatactcaagatactgtttttcacagtgatttccaatcctggctgcacttcagaatcaacaggggagatttcataaatatgaaatagctactgtccacatggtactagagagtcagtaggtatgaggtggagccgaggaatataccctggatatttcttctgtgctgccaagtttggaaatcatcagccaactactggatgaagcaaataaactggcaggggaggacagaggaggagcaccttgaggctctgctttttcattgatatcagtccctggtattacaaactaacaaaaaccagaactaaaaaggattttggaggttatttatccctgactcctcattttacagatcagaaacttgaggataaaaaggcaaagcaatttgcctcaaatcatataactgattggagcggggagcaggcactcaaattcaggtctccttactctcagtttttgttctttcctttgcattgtcacatgtgtctctgtaaatcagtgagggcttagtaacaccaaactggttgattagttttccacatctaccagattaattttttaaaaatcaaatcactttggtgctgtgataccaagtaaccatttactttacagaaatttttatttatcaatccagtgtttaaataatttataattgcagcctctattatttaatagttattttgccctcagtaaatattttcatcccaaaaagtccccaagtacttctctgctttctcctttgcaaacctgctttccttaattttaacaacaaatcttttccttatttgttaatggactgcactttaattgaatgattcaaaatagtttaatgatataactgtttattagattgagtatgaaattaggaatatttgataatttttgttctgcaaaattggtgaatccatatgttttatcctaatgcaaatgtggagacaatacgctggaatctagtaacagtagggactattatcaccccaggcctgaatggacaagtggagggaaaggtatatgaacccgaagacagagaggtggtgtggtaaaggaggccctgcggaaactgaagacttctgtcttaggacacggccagcctatggcaaccccacaaaaggaagtggagaaataaatatcccttgttcactcactctcatattccagtctctactgatggtccccatagctgagctcaaccagaaaccagagggcaaggcagccctgctggagatgtacagatttatttctgtgggcccagggcagtgggagcaggatggaaagtgcatctggaagcacaaatagaagctatctagctcacagtgaagggccaagggatattttcatttttgtttctctgcttaactgtgttatgcaaacatctgtagatagcctcatctttcaaaactggcttttgacaattctgccaacccaataactaaaatgcgtgaaatctgcccagagcatgcatcctgtgtgacagtggcgtggcgtgggaaagcagcttaatttggcttctaatggctccagagtgttaataatttttgtggtatgaatatatgcagagagacattataatctatcttttaaaaccatggcatctgttatcagagacaaagtccagtcttacctgcagaataatgggaccaagtgtgtttatcttgatgaattttcctttttaatgtcaattgatttaaagaaaatttatctctaatttaatctttgcaatatccgagcaatggatggaattatccccatttttaaagctggggaaaccgaggctcggtgagagtaagtgtcctccgtagcatgagtacttagagatgggattcaaatccagacctatctcacacagcagccaacctctcttctttaccacttggtgctgttgattgtctttatttattgtcctagaaagatgtgttcttaaagaaatgggctcagccattccgaagtgatcgccgcctataaccagacatgcccactacagttaattagggaagctgaaccccactgaggtgaaaacagaggtagaagcaattaactaagaatctctctgcagaaaacagtcacattttggctctccatttcccattaagagtagaaaccgtaggaaagttactctctgtacggagcaggccaagaaatgaggcttccgtttttgaataatcaactacattgatctgggagcatgctcagtcacattacgaagtatcataattcttgaatagactctttctcttctttttttgggagtctcacacccatatctccctgtctcccatctgtaaatgtaaaagggacttcttatccactgtgagatcttgttcaacctatcttcctgaaatagtcaaaattcaggtttttttctgagtttgctactaaattatagaaaccatgtagctttatgcatctaatgagaataacaaaaactgctctgctcacttcccagcggttgtcctggagcccaaagaagcataaagcttttcaaaactcccaagggcctaatattacaagtgattgctcacaaggttgctgtcaactctcaccttatgactaactccctaggtctctgtacttgacttttccaacaaatctgttactctattaattgctcttggcagtctcattattgtcattgctagatgtttccactttcgtaggctttttaggggtagacatgcccagggactctgccagacacagcacataggctgtcccccagccaccactaagtcaaaacacatatgccctgcagctcctgtatcacctagtaacctttaataaaccccataagcaggtgtctagggacctggctctgccactaggcacctgatttcctaggagaatatgagtgtgagatttagggagccagagaaattaacaggaaactttcttctgtgtatagaggagtgagattgattcacccaaacacactaggcattcttaaagtatgtttgaaagaaaggaaagaagcttatctttatgacatgactagcacctggttcttccaatgtatttttaacctaacagacttgctggttttagctatatgagagcaaacttcctaaggaaaaacaataaaacattttaaagatagaattttatcccatcaatcaagtacttattgaccaccaaaaatgtaacttttagccctcaggctgaaatgaatttatactattttggaaacatatctgtgacatccccttcatgatccctcacaatgagccaagtctcacatggaaatagctttgtgagtcttgcaaccacacatatggggtttggtcacatttttacctctttcaaactgtttttttttttctacagaaaacaaagaggcaaaaaacttggatatttttctctatatgcctaaaagggcccatttccctctgaagttagacaaaatgaaaacaagccaccaataacaagccacttacaatgatcaatggggcaatatcatatgtgagaacacactgtgcctcttgcatattttcaaatgtctgtttcttccataagagaaaatttggaaacacatgtccctcctcaaatacatataaacagcatagactaaaacaaaataactacaatgacaaaacttaattcatgtctgtagattgtgaagcatacacttcacccagaggaaataaactaggctatttgtttttaagcactttctctattttaacacagtcgttttccaatgagagttttgttagatctcttatctaatcctccatatacaagcaacatagggttgctctctctaggcatgggaaaatcagtttaagaaagggaaggaaataattctcaagaagacatgttttatacattattcatccttgaaactgcttatgtgccaccaccaacaggaacacacatggtgaaatttgtattgtatttcaccttgaaaatccatattctgtcatagaagtccaatttcttgagtatcttttctcatccaaaagattattaaagtagattacagttgaaactgtaaattcagttatcatgaaagcagttttccccattgtaatacatttcattatgaaggggataaacaagaactaggaaagattttattgctattttcaagacccatcttttctaggatagaattcttcacttctaaggatacaggcaaaatagtatccaaaggctgagaatcatgtcatcaacattactaagtcacatgaagaatcatatatttaaaattacttgaaataaattattttaaatactgaatttttcttgaaaaactgacactccagaatacattagattaaggtcctccctagccaagaaaagtagagacaaggggaaaaaagaagaagaagaagaagaagagacaaagaaaagcagccaaaaaaaaatttggggaaagagaagttattgaacattgtcaacctacaaatatttattgaaattgcaactaatatgagaacgacaaccacagttataaataaagaaaagcgtatctatcagcatgtcatctgtcagtaattcgggcatatgttttcttcaaaaaaaacccacaatacataatttttaaagacagtttattcttaagcaaactaaagacagacagaggggtgggttttgtgtgtttgttgttgttgtttgtttgttttcattttggaccaattcagggtcactgaatcagcaatgattttcctcaccaatgcccatggggatatattaaaaagttattttttgaagaggaagtttgccttatcccaaatgttgtcacactatttctataaggtttttctttggttattattttgttgagggtaaggaaaacacacacacacacacacacacacacacacacacacacacaaaatgccctgtcctcactgtcagtggagaatccctgtggatttgtggtccttttcccattaaagtagtttcttccctgggtagtttttggaaagttatattatctcctgaatggccaagggtgagaatcttattccttccatgttctttttttaaaaaaagttaaactcaaaataactcatggcataaagaggggctgaatacatcctcagtttattgagtgatgtgaaaattgcccattgttatttgtgtcatttgagcatttcatttccataatatctgaaatgttatttttttttttttgttctatctgctcattcgatgagcttcatgtagaaagtcaggaggcagaattaaaagcattgttcttgctgcatctaaaggaagctagcaggatacttgtcattttttagaaataaatttctctctaattttttttatctggttctgaaaggcacaatgcagagagattagtttttactggaaacctgagcactttgcacctcagaaactgaaacaatcgagtcctattttctatagcctcttatataagtaaagtcaaatgagttccaagttctggaaagcaacatgaatgtcttctaacctttattttttcagaacgattgagccaccaggctgtgtaggagcttcttcttaggtagtcacaggaagattagcttagaatggatgctcagagccaagacactagagaagacaaaacccagggtggaaactggactcctgcccagcccaagggaggctggtgcaagggacagtatgtaaatgtgacagaggtaaccgagatagcagagtttttgagatgagaggtcaatggtaaataaaaccagattgaaatgatctatttcagtagcttatggaaaaaactagattgggaacgaaagtgtatgatgcatttgaaggacaatgcagagacagtaatgccaagatgtggtaatggaatgaagtatcctaccctggtcatctatgctacttcagtttacttatatgtcaaaaccaataaatggtcttttaaccaaggtcacatggtgcagaaaagtatagaggatttctttattcctttttaaagttattatttataattggatgctttctcatacggatttgaaggagaatctcttcctaaagtggatataaacatatacccaatctccagtttctttcatttggccgatcttggtggtacctctacacatgaaatcagtgacttacaaatggtatcttgtgacatgttttacacagaaagtcttcatctcaaaatttgcagttagcttcccctgctttgagaaggctgtcatgaacttagtgcagaatttgttatatatttgtttttattgtcaaagagcttccaattgagatggtagaggtttgcacactccgttagggtatgttggatcattgctggaacgttgtgaagtgacactcgatttgatatttgttgtgcttagctggattactccagattacatcattgttcttgctgaacttcaggatctaagtcctcgctcttctacttaacagatgaatctttaatattgagtaagttacttaacctaactgtgccttgctttcctaatgtataaaatggagatcataatagtacctttctcataaagctgtctgtgaaaaataagctaatatgcctaaagtccacaaaacgtcatctgacacacaactctcaaaaatcagctgtcattatttgtattatcgttgttagctttatcattagggctttatcacctgtcaattactaactgtggcaccttgttcatttctgtgtgatacagcacaggaggtgtgaaactcagggcacttgtaaaacactgcttaaatctaaaagggactaagcataaaagtagaatacacatatgtagaggcttgtaaataacaaataacctgaagggctgtggtctgaaaatatacagctaaataagtggtggcttgagcatccctaatgaagagtgatataagactctcactataccatatagagaaaaaaccctaagagtactaagtggttaacttttattcccctatcacatttctttgttgttgttgttgttgttttgttttttaatcagaattgtgtagagcctacacttctgtttgccctggtattgtcttcttaatacttccaaagtgcttcctttgccaatttcaggatcatctcctgctgtatttatctcagatgagacttttttctccagtgtttgtttttaattcttttcctaaacacaccaaatcacaaccacacagttccataaactcaaactcattttctctgaggctttatcaggaatcatctcaagattgcataacagactcacttttaattgaaaatgttgcatccttaaattcctctggagaaagattgcagtattttcctacaaagctgcttactgctagactttctgatgaagtttctacttcattcagctggctttaaagactgtacaggttgacagttttccaggtgagccgagggtctttttgtcccttagtttatcaactgaactggtattttgacaaaaaggcctgtaattcctccttatgaggttttaaaatatatgtgaatcaaagtcaggatgtttctcattgggttgtgagtttactgcaacaggagtttacaacaacaggagttgcagtaaattcactgcaacaagtactgaggagactctctctgaaccctaaattcttccaagatgtggtctgcatcagcatcacctgggcttcggttagagatgcagaatctcatgtaggcttttacatgggcatcttgcgtggagttgaggtttggggtacaggtcctgtcactcaggtagtgagcatagtacccaataactggtttttcaacacataccttcctctctccctcttgcctctagtagtccccagtccctgttgtttccatgtttatgtccttgtgtgatcaatgtttaactctcacttgtaacagagaacatgtgatacatgttttcctgttcttgcattcataaatttaagataatggcctccagatgcatttatgttgctgcaaaggatatgatctcattctttcttatgtctgcatggtattccatggtgtatatgtatcttctgtatctgtaataaaaggagaaatttaaaaaactaaaaaataaaattaaaagattattatgcttaaataaataaataagaaatgcagaatctcaagccccacaccacaccttctgaatcagagtctcaaattatttctcatggacaaaggctgactggtgaaaaacgaaacttgtgtgatgaccccatgaagtgggaccctttccatcatttttttgtttgtgtgtttgtttgttttctctgtaattgctctttttctgaggaaatacagtttgggatggaggggtggaaagaagggactctgagtatatttgattcagacaaaacttattttcttttaattgaaatgataaggggagcagaaaaggacatgcttttaaatgaaccccatgtaaagatggccattgcagaaaaagtattcaattgcatacataaataggacttcagtggcgagcatccttcttagtgtcacatgtaattgaatttggctgataaataagccttgcatctcttctttatgagaaaaagtgcttatggattttacatgtaataggttcaagggttttgaaaagttctggatgatttgcatgcagtgtaaataatttaaaaatgtgaactattgttacgaggtgaaagcaagtatactatcaaaatttaactacgatgtttacaggcaactatatttttaaatattttatttgaggattatctcaagaccagaaaggcattaacataaactacaaatcatgaaggcaggaagtgtctcaaaaaaaaaaaagtattacaactaaatagataaattgggggaaaaagattactcctgaaatgtagatggactgttattgagctacatatcctgtaatatctgaatcatataagaccactttttgaagaaaattgttttatttaaattttcccatatgattatcctactaccataattttcatgtgatgttacagggtatatattacagtggttcattatctgaaattgattaaaaataaaatggtgatggctgagtagctcctgtctggcaaaaacctctcacagataacaactacaaaccctgaacaaaatataaaaagaaattatctgaagaccctggagagagaccaagacagggagatgctagaaagaagatgagactttaaaatggagatagttgtgagtagagttcccttggttttatccctttccaggacaagtaaaactctgatagaaaactctcaattttactgacttgaataatataagacagaatttagggcagctacagctccccaaaagtgaaggaaataaatctcaaaaagaaaagagtcagagaagaggggcctcagattctgtgtatatacttgtgtgtagtctttcactgaccacataaccatgtgaatgtggagtccatgagcacatcatacttgtttaatatgtattatttagtgtatgaatgaaaagatgatctaacagccatacccttcatagagcattccaacaagctagaatacctcatatcaaatgtatttactttaagaggtctgacagagaaaacagaacatctcaaggtaggattagggcacctttactaatctttaaaggaggtttttccattgtcccttgtttgacatttggaagttgtttaacacttgagtaatgaaccacagtaaactttgttccagatgaaaagtgttcttttatgttgtaaagtgaaaggatagatggaaaaggatagcttaaagaatgctacaaaatggtgcaaatggccatggaatattcacatgccccttgggcagcctttgcctatacccaaaggcacatacgcatgcccagtctgaagaccatagcgcaaagggaaacacctgtttgaccaagactgcaggggataaatgacagggtatagcagaccttagggactgccatcctctaaagaactcacactggaaacctagaaaaacttgacaaaaatttaagatgcccccacaggaattcatccagcattgtaagttttctattgatgtcagcagcctgaccgctgcagatatgtactgatctttgtagacatttgtaagaattgtagtgctgttaggtaaaaagttccctggaatttatttgtcagatcatagataagcagctcttgtttggatacttgataaaataatattgaattaggagttaaaatgttttcaatcgaacaacgttataaacactacccaaagccttattcattttgatttaataagcaactactgctcactttctatataaatattattgggtttaagtcctgagggtggagatggaagaggcagcagagacataaaggtgatgaatcaggtagaaacatatttaacagcaattacacattcactcaatatgtagtctagatatacattaaataaaacttaataaaaaaattaacctggccaatttaaccaacatagaccacaaatctttatcattcagtctctcttaaaatgtcttttccttcaggtaaaatatttagaaattgacttattgattcttcttcacctgttcaagtaaacatcacttcacactcttccctctgtgctaaagcaaactgataagaaaacatttttagaagcttcagggaaatgtaaataactatctttaatcattagagatcatgctgaacatatagaaaagtttatttctgttttgaaacaaaacttggcagaaataaaattggcagctttgattcagtgcaaagtattgtggagttggtactatttagaccatttcgaaataatttttaaatattttatttattaatatgtttgtatagtggggaatgtggttttagttgtttgctgtaagtttccaaacatatttatttggccctctagtaactaaagaaacagagaagatactcttcaggctcttcattttgcctcagttttgtccatgcgaatttgaaaagtaaatcaacagtcagccacctcttttactgtaaagtagcctgtattgcagcccgccaaaaatagaaaagttggaataaagtagaatgtgtttgactttggcagaatctgctaatctgttccttataaattttcacacaaactgggtagattatttaatattaataacataagccccactagtctgatccattttttctcctctgacttaactgagaagagaatttttaactgtcttaaaataggctacaaaaattactttttttagaaatcattgtacatagtggcacttatttgtttatgtatctgtctccccaccggaaggtaacttctttgattgcaagcattgaactttatttttgcagccctagcccaggattggacacaaaaatgcaagcacagttactgcatcaaacttagccactgttttgaaaaaccaaaagagcttatctaaagtatgcattttaatcaaatcctggcagaatataggaaacatatggctgttatttttaattctcctttgccaaatttgttttacagcaaaacaaaactaaaacatctcacaaaattttccttaatgtgttattgtacctaaccatatgaaatcaacacagaagctgaatctaataccccagttttaccaatgagagggagaaattgcagtagttttttgtgtgtgtgtgtgaaagctaagagtttttgtgcacacgaaatgtatcatgagaattaagtataccctgaaaatgaaatatgcacaggcttggccttgccaaagttttcagagcgcttacttttggcaacacttccctgggtcttctctttgtgaacctgtgaagatggtgagtttcttaggagtagggactctgtttgacaactttggatcttctagcctactgcctgcaatacagtacaagctcaataaatatttgataaaccacattccaaatctgcattctctgtgatcccccagcccctcaattttcctactctatggtttcaaagagtgataggacaaaatgtgtgtgtagtcccttcctgaggtattggcattttagtaaggaaaacagctttaagctaaagaaatgaaaccgtatggcatgtcaggcattctgaagatgatggaaggcattctgaatggcaagatagtattccttagctccctgttatacatggtaataggcctgtagtgcaaatgatgccaagaatagttcatggtggattttcaattgcttaaaagtaggacataggccatgatcattgcttttcgttgtttccacagatcagctctggtctcctttctatttctcatacttaaggtcttcctctatttctcatacttaaggtcttcctctacccccaccacaacagaaaaacacctcaaaacattgattacctattataaggttggtcttgtttctcaaaaacaaaaattccaaagcagtttacatttggaggcactctttgctatcgatggttcttgaacatattgccacacaagatttcctatgttatgtagattagaggaattttcttaagtgtccttgaaaaatataataggaaataaattcactactgaacatctatcttctatgaagttttgaggttgacttgatgtattagactaaggaaaacctgtgttctataattctgattccatttttaatcaaattattataaatgccctttggggcattttgtggaaaagatagattaaatagtgtacccaattaaaaaactgaaggatcccttccgcttgaaagttacatactgctcaacaaactgtatgttttattaaaacatgaactggtagtaagggcactgaatagtgatatgactcattgaagccaaagtggataatatggctttcacttacatatcattcacagtggcaattatctctttttatattaatgaagaaaataaaatagagtataactcacaaattttatctatttttggcttcaagtatttcttgttttacttggaagtgatgcatttatattatttgagtgcagatttttgtcttgcaatttggaagatcatactacttaaacaaaattacactggtgtgacttatctttagaaagctagtggaaagttgcttagcttatttgatctgatctgagtgacttccttaataccccatgctgctaattaagaaaccatctcagaatgaaggtaaggactaaccctaatcaagaggccccatcattttgtttaatgcctggtttactccacccttgacagaaaggttataattaagtcaggggctatatgacaatatcttattcatgttgatactcccagagctagcttagttcctggctcatagcaggtgttccataaatgtttgttgaatgcaactgaattaccttgaatatcttgggcacaggattcttaatcaggggcctaaattagaaattctgaaaaatagtttgaaaacaaaaagagagatgaggtgtggttctgtatatttcttaaaaaattatcaggtgacactgataaaccaccttagttatgaaacaccgatctaagtgctaaactatttttgtgaaaaattctaatagtcagcttgatcacctagatatttctaattattttcatgaggtgtttcttttaaaaatgaatagactggtgatttttaaaatttgtgtgagcttttgaggcctttagcctccaagcaatatcttgcgtcaaacccaaatatggtcaattctcatttttattcatgaattccacctttgcaaatttgtcttttcctataaattgtttgtaacccccaaatcaatactcctagcagatttgctatcattcacagacattcacagaatgtccagaaattggagccacctgatgtacagctcccagctgaggttaaagaaggcaatgctctctgtgccttcttgtttcagttctcatactacgaacaaatgtcctttttgtggtctatttagtgccacaatttttacatttttatgaatttgtaaattggttggtgattttattgttttaaatagcccctcaagcatagtactgaagtgctgtatgatgttcctaagtacaagaaagctgtgatgtggcttacagagaatatgtgtgtgttggagttttcttcaggtagaagtaatagtgctattggttgagagttcagtgtgaatgaagcagcaacatatgttaaataagttgtctttaaacaaaacacataaaacaaagttagctattgattgctgggtgaaaatatttgtgaccagaggcttacaggaacctaaccatgtgttttccctagaagcaatggctcagtatttgctatttcagtttttgaagcaactttatagaccataactactgaaaataacaataattaactgtatataaaactggaagccaaaattgctctgggtgacaaaggcataagaccatcatctttgttctcttcccatctccttctccccaagtgacagcctccaaaacatatgcttaatttctggatccagaaagaatagggcttttaaataagaatagccttccaaatgaatccagagtaacaactgaatttcacattttatttatatacttgggtgttatgtaaatatagcaagtacttgcttagaaaatacaaaactaacattatattaaataatcccagttaggaaggtaatcagatgggggggagggaagccagtgcttttctgagccaaatataaattacttttagattacctggtgtttttaattatctgcaccactgtaccactttggtcagaatcagaggttgattctacctctgacaatgccatatctgccttctcctgggcccagagggcttttccctatgttcaataaaccttgaaagaaaaggaaacacagtagaatatctgttggctcagcacaacaggttttgagtaaacgaattactactcttatgcattaaataaaatatatggttcggaaaaggttgctacagtactgaaagtcacttcatggctatcttgctttttaaggaaaaggcctaaaatgcagtcaaattcaaaataaagtaagaagcagcataatgtaaaacagagtatttggtaaaataatagtaatgcaaataaccactccctaatacctaagattttgaatgctaaattccgttgtcattattgttgttgttaagacataagcacagctaagtaccctcagtcacgcatcctcaactggggacattttgctccccagggaagactgggcaacatctggagacatttttgattgtcaagagtgtgtgggagatgccactaacatctagtggatagaaattagttatactgctaaactcccaacaacatacaaggcagcccccgcaacaacaacaaaaatctactccaaaatgctaatgtaccaagatgaaaaatcctattccaggagtgactagtaaataaaagtattccattatgcagtacaagcaatggttatttctatacagacaacaatattaatctgactcttccaagggtgtggctcctacgtctgcattgagttctcagcaaggatgtcatcctaatctctgtgcccagagagcgcttgatcccaatatacaaaccaaggctcccatatgaaaacaaaagcataaacagcagctaggctcagcgtatctcctgggtttatatatgaaatttatcacctgactctctcctctttactgctaaaggaacatcatcaacaaatcagtgaatttcagaagcagcattaaaaatatctgcgttatttgcttcactggccatagaaaaggggccataaaagtcatgcatcaaatccttagatggtgcctaagattatgagtctgacaaattgcaggaaaatgaacccatctgtgtaagtccgcagaatgcaacaaggaagaacattttgtggactagttttccactggcttatttggctatttacatgtaatagcagtgatctgtgcattcactctgatttgtgggtatagcaggtggcacatgtttacagatgcttgggaaactgccttgcaagctgaatgcagatactttggcttgttttcacatttgctctgtgctccctggcagatctttacctgtgtctttctctgagtatcttcctttctttctgacaggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctggggtatgtattttctgcagctaagttttgagtcactttcacctctgtctgtatgctttcagtcttcttctagtcttggtctcagagaatagagtcaagtcccaggtccttcaaggaatgatggaacacaggtactggcaggagttcagtctccaaaagacctgtggaagccctttaacaatctcaactgtgctgaacatgagggtctgcacagagaaggaagataagggtgacttccaaagggtaacttcaggaaacaaacctagctaatgatggacacaaaatgtgtcctgattgagagaagatctgattaggcctccttctgctttattcatcacatgtttgtagagcaaaggagaatttcacattttgaattatgtacctcccctaccctggcttcattttccttcatcaagaacatttcttcctgtcaatccatcatcaggattcctccagtgaaagctcaggaagtggagtccagctgagaggcagatataaccacacgggcttccaagtagagcctgtgtgacatcatagcacatggcattggctcgggaaagcttagggctggattgtttaagctgtggctgcttccgtacaaactaaggcagggtgctgaagtccttcagggatgctctagaattgctccctttcccccagggctgctgaaagtccagctccccctggtggaagggaactgaacagaaggtgaggcaatgaaagaaaataaatgctgcgataaaaacacatgctgccttatcaaaaaaaaagtttcagccttaccttgaaacttccataccagaggaggaactcgtgggccatccctcactgactatagagccaagggcttctctcaccacatccaccccacatgatgggtgactgtgactctgagagcagaggctgtggatggccttcaactaagcttgccctttaatgcagcaggctggggagcccctacaagtactggtaagagaggagaggtgtagtgaggagggaggacaatccaagggattttttaaaaacatcaccttttgtatttaaagccctgcccaacaggcattgtcgccaactttatagaaatgtgcttgggaagtcatataagcagcctagagtctttcctgcagtctgtaaactgcagaaaggggctggtgttatgccatactggtttccataacacccttacataacaggggtacatggttttaaccaaatgcattgcccaagcccaatgggataatccgataatggtgggtcaatggggcagataggcgggatgcctcaaaattgaattgatgatgctacaattatttggttgcaagcaacagagtaagatgttctaacttaagcaaatacagagaagttgtcagaatctagcgtatctcatggaatctaagggcagaaatatagccaggcaactaaaagggctgtagcctgggagcagataagccaggagctctctccctctgccttttgtctttgtttttccttgcatatctgtttttacccttctctttctttacaggccatagaccatagggtctctgctccctccagttttcatagtaaatacatcctgccccaaagtttcctgagtacacatgtttctgttccaggcactcacagaaactaaatgcccatctttaagttccaattctgaatagcaggacaagaaaatctgattgatccaactgaaggcaggtagcctaccctggttcaataaactgtggccaagaaaattgagggggatgttgtcacatagtgtgaacatgtctagtgattgtgaaccctccagcaaaggactgagaaaggggtctttgtgaactgtacaggctgtctaggatattcaccagatcacctcatctgcatggctgctcccttataaggagagcagcgctgcaccctgtttccttaaccatccagtgaggttagaaatcaggctatcactatcctgctggttccacatcaggtaacaggttctcctgctctttcctgtcctaaaacaggtcaaaatttactcaaaatggtcttttactatttttttttttctcttttagccccagccttccacagagactaatctttcctttccctggccttctcatccgtatgtacaccctctcaacaatttctagatttccaaatctggtcatgctaagaatagactggatacaatttaatcactgcaatggcaattctgatcatcacaatcataataattggtgttgatcaaatgccttccagtcaaagacctgaaaataacattccaccccaaacacacacacaaacacacacatactttctgccagatttatttcctttgaaataaaatctgtggtatatttcttttaccagttttgattgttcaaaacatctatctgccatactcagaaaatttttcatgggaaaaaaaggctgtaaatgtattcttgtcggtgacattcagcagagacaagggcaccctggaaggaacaatttatactgctcttggagtatactgatgcattgtgaattagttataaaactttttggcatcatcatagacagctcaatgaagatatctgcttaaaacacataaacaattcaaaggaaaaaaggaacaagctgctcagctgtatcaaaaacaaaggcaataataataagtaaattgtttatgtgataccttaagcttctgtaatcaacaacaattcgaatgattcaagtagaatcccaaagaacattacacttagtaacgtaagcacagaacggggagttgctaatcaatggttatacagattaagtaatgcaagatgagtaaattttaggtatctgctgtacaacattgtgcctataggtaacaattttgtactatgcacttaaaaatctgtttagagggcagacctgatgctaattgttcttgccagaataatataaaaatttaaattaaaaaaagaactagagggatttgcacttccgtagatggacttttggaaagatagtcaaccaaatagttctaaaatgtaatgtttttagcatgccaaagctaagactatctttctacatgcacacacacacacacacagacacacacacaccaaaattccaccaaactcattaccactgaaaaatcacattgccaaatctgaactctgagaacaaaattgacatattttaaagcagtggctcctttcttagaattttaagcaagcattatctttggatgggaggaaaatgggtgaaattaataccaattaatttctcaagaaaaaaatagtttcacagaaactttataaagtttaatggggcaagagaataagtctcttctggataatatttttattgtcctttgaaaatttttttcacatgaagacagtatgataggttctaaattttacaatgccagaaaagaagcaaaacctacatacttttaaaagattcttgaaagttagactgcagaaaatatggcccaaaaaagcccagttgtattatagcacctaatttgtttgcaggtgatgtaaagcccattcatttaattcagctgtgaataatgtttccaattctaggatttgaaatgaatctcaaagaatgataagagatattgtaaacattagccactgggtgaacaagtatctggtggtgaaattctccccaacagaaaatcaaagaatggttctttcagtagttattcccttccaagtctgcatggcaccacttagtagtcgatttctctccaattgaagtaacttcaaatactgaagtttagttctcaggaagatcacttattttgcagccctctccagactgtttctttgccttgccttgctggttttccccttgttagaaatcaaaggaaggaaatttcccccatggacttctatattgaacaaatagaatttattaaatccctcttaaaaaatgaatcctacacagacaggattattctgaatctcatcatctttggtgggaagaatgggttgttatggatcttgggaccttggggagagagaaagaaaaaagaaaaaaaaacagaaaaagcaaactacctaaaaggaggcatcatagctagaagaaggcaaagagccctgggcgttaaaaggtgtggggtctatactcgtctccagatgaagtagaaagcactttcctttctacaaaatgatgaggtgggattcagttttccatatacttctctttctctctaattctaaaatatccatctcaaaataaatccagagactttgtttctctttctgagcccaagtgggaaaatggtatgttagaactgctgtgaataacacaatcatgttttgtataagcaaactcaaaattatttcaggccaaacattaaatctgtggtcctattgaaaatatgcttcctgggtttaaaagctgaggttgttcttaggtgaaaattcaatattttgagacccctttttgtatataactcacagaaaataaaaatgcattgatttaattctttcctaagacacatttcttaatctgatgacaataacaaaacctctttctacagatgtctcaatcaaatcaaacaatattctactgttgtacatctgagtaaaaagacttattttttcttttttaatgaaaattacaactttaggttatactacagaataaaaattgatttaaaaaattataatctggaaggacgtattgcaataactgtgtccatttttctgtttataaattaaaaagtttttttttttttactagcactttgagtttagtcaaggaggtacagtaagctgccttcataaagtttctctagccagaacctacagaaggtagggaatgtactggcttctctgaagtattcatattaaaaggaaacaatcactgcatgagatataaacagacagaaaaacaaaagagcctagaagaaagaatgtgaacatcagctaaggctttaggagcaatcagactattgctttcatacaccgtcccaggtcacatccctccggggtgacccagctcctctccataagagaggccagttcacccacaatgaaaggctttctggtctcagttaatagtcatcattataaacataacaatggtaataatagtcatagtgtacctgctacattcagcaatttgtaaaaggcttttaattatttggatgctcttaaccaaactctcaggaagcacatgatgttctaactgggagcattttgactggcttgaccaaagatgatttttgtgaaaatatcaggggaacatcttgacagatgcactcaatttgccagtatttttgcaagtacactaccattgtccatgcagctgtacttaaaggttatgaccaagaaaccaagtgtgatttgtacttttcacatttgtagggttcccgctggtgccaaccactatccatgctattaccagggccgtgtacttcaatgacaagtaagtattatggtgatgtttaagttaacatattcataaacaaaatgtatttgtgtattaattgtccccttgccctttttcagctgctggctgagtgtggaaacccatttgctttacataatccatggacctgtcatggcggcacttgtggtgagaattagttttttattgcaatattagtagtattatctcttagttgagatttctgtgtatatagttctatgtatcatatgttttataacttcaaaatgaagctaatttgatggtattctgtagtaaaaaaaagcaatttgattttagactcttcaaaaaaacgccttttactcacacatggaggggttatcatgagctcattttcattacagactcacactataatagcaatgtagctcatattttaagatttttataactagattctcctaggtaaaggtgagaggccaaggggctgcaagaagtttgtttgtgttatgaacatctagggtctttgaaaactttgacattccagagctctaaaagtctttggttctgtgaacttaaggtccagaaatccaaatattcaacacaagctcaattagtgagttagtaataaatagtggactcccagccaaatgtcagatgcttactgaggatgctacagttcttacttacctaggattcagtagacttggcctcatgtcttagctctatcatctaccagctctgaaaatttagataaatcaattaacctaaaaatgtcccctgatttttttaagggaaaagttagattaaataatctttcaggtacttttggaagataatctctaactctaggtcattaaaacttagtactgctccatatctttatctgttaaaaataacaaaaataataatagctactcataaattcacgattataaaatatctcctaataaaataataaataaagtaaaatgaagtaaaaactttagcaattattcctatatttaaaattctaaaatacatatttcttgccttaattatctagaaatttttaaggaaatgcagattctaggatccaaattataaatgtgtatctgagttgagtatatgcatacttcactgtgaatgaccataaattaacagaaattgatatatttggaattcttattaatttcatgactaaaggaaatgcacattagtgcatttcaaaactaaaaaaaaaagattcaacaattaacaaggtgaatcatttataccttaatagttgatttttctcattttgaaagagctgcccgtgcaaatatgggcacttgatttatgacagcagcacttttgggcagaggaaggagatggtcaataagatatacatacagaaaaaatatcaaacacgtatttagcaactgcatatgtgtggggaaaaagtaaattctgattccttccacaaccagacaccaaaaaatgtgtttttagtgaactggaggtttaaatgtaaaagacaaaacaatagaggccccccaaaaagacacattatgttgagtatcttcatgagcttcagatacagaaagatttctaaagcaggatacaaaaggcacttaaggaagagattgataaatcagctacattaaaatgaagacaacatttaaagactgaaaagacaaaacttagagtccaagaaggtatctgcaatgttccaaataaagactaataaatttatgaaaaagtgttcagctcatgtatcatcaggaaaatgcagattaaaacaagaatgaggtaatactacacccctccaccacccccgccatagaaaggctcatattaaaaagagtgttcataccaagtgttggcaagggtgatgagcaactggaactgttttatatactgctggagggaacataaaattaaaccacttctctagagccctagaaatgctgagccaattgtgctacctctcaggtagactctcatgttctatgtaggtaacatttgttgctcacactggataaacaagaattgagaacagtgcatattcttaagtgatacttttctgtatgatttgctcataacaccgtatatttgcaggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccaggtaaggaagccaaaggtgtatttattcaactactgtgcttattcagctagctgattttaactctaaagcccatgatcttttattattattttacttatttgtttatttatttatttatttattattttattttatttttttttttttgagacagagtctcgctctgtccaccaggctggagtgcagtggcatgatctcaactcactgcaacctccatctcccgggctcaagcaattctcccacctcagcctcctgagtagctgggattacaggtgtgcgctaccacgcctggctaatttttgtatttttagtagacggggtttcaccatgttggccaggctggtatcaaactcctgacctcaggtattctgcccgcctcggcctgggattacaggtgtgagccactgcgcacgcctgacaagcccatgatcttcaatgtcataacatttaagcctccaattcaataagcccagccaaaattctgaaggacaccagtttttttgaggctctttgttgctgtttctttctgtgcctgctttcctgtcattcccagggccctcagctggtcccatccaggcatgttctccttggtcatagatacagaaattgtcagatcttcctttataaataagtgctggctctggggtaatgaggaatttgcacaaggctgtccatgcctcctgctctatcactctccatttgtcaggtgaatgttaggaatccattcatgacggttcagtgctataaagggaagttgtatccaggcctcccctcatgtaagagagaatgcagtgggctctcaggggctgtcctgggctgtccagtgtctgccgcactggataggagaatggctgccctagttccattcacctttacccagatctaaagccccattgaaagcataatgctgtatttggatagcaagataggatgtgggagtccttggcaggagtaattctatcacaggctcttaggccagagttttgctgtctctattacaaatttcaaaatagttttattttctatattaggcttaatgtgaggaggaggtcaaaattaatagggccagaaagaaagtttagggatcgtttgaatagttcgaactgttcttttagccataatcaaaacttgggcacaagaaatcttcaagcagtgaccaggactcaggcagtttcttagtccatgtccttatctgagcgatgaacttggcggtgggtacagtattgcactagttcaccatgacaacataggacacagacccacagcctcccactatgacacttgtcttgtaaaagatccctctactgaattctgcaaggtctccatttttaaattttctaagtgtagtttttttttttcaaattcaccataatcagcatatgctgctataaatctccatgttaaagggagcaaaatattatttagattagcaaaatattaatccgtccttctagccaaacgatggaatcctaacaagaaaaatatatttctaagggaatattcttatagtgcagcactgactatgaatggtagataattctttttcttgctttttttttttttcatcaggccttctctgggcagtctattatattgtttactaaacaacataatgcacacaaaaataacttcaactgtatttttccttccctttttagggcttctttgttgcgaccatctactgcttctgcaacaatgaggtaagcatgcatttcatataatactatcacttgtttgtgtaaaggcagcattttttccaaagggcctctgtacaaatttcatttcatctcacttctacagttgacctcatagggttttgtgattagcaacatgatgttttttccactactccaagctgaatcttatccatggatgtgtagtacaatggcaaatatgattcagacaggcagttaatttccttgggttgcatcttgaacagatcagcaccctcaggagcaatagtgaaagctattctggatgccatcacaaagagaagtcatattcctattcccttcggaagacccgagccctcactagggcagagacaatctccattcggtttgtactagttcctcaccttcttttccagttgcttggtgctaacgccctactacttactcagcgttttgaaaatcaccctgaagtgaagattcaaaaaggattctcaaataatctacaatgtgaatatttagatcagtaaaatctagagagccatatggctgatccattctgttctcagggtgtttttagccagagttaccctttcttccaaccaaatcttgcctgggagccaaatctataaaacataaaaatggagcttctatagctccagacatccttccaaagaacttccagggttttagggaacatgattcaaaatcttcctcatttttcagggaagaaatctgaactccagaaagatcatgtgatttacccaatgtcacaaatgcacttatggttataacccagactggaacacagatttcctgtttttcaattaaactgaccaactcccaattaacttatctatatctataattccttcctggagctatgttagtatgttttttctaggaccacacaacttttaatgccaaagcatttttgaacattttaaatcaattcctattaagaataattccatacaaggcaaatcacattttgccaagacatcaatatattactttcctattagtaattagaaacatttctagccattgtcagttgctaatttattctctatctttttactaagttaaataatatttagtgagcacctacaatattttgctattctgtgacctgttcatacccgtttccaaccgcaacatgacaaagtttttgttgttcctattctccattttagttattacattttattcctttctttcttcatccattcacctaccaactcattccttcattcaacaaaaatacattgtgcatttactattgctaagggctagactaagggcctagaatagaaatgaaaagacatccttccattgcccgctgttagagtggcaatatttttagaattttaatattttttagaatgataaaaactaataaatgagtagggcgtaagtcaccccgtgtttatatcaatttctgtgaatgtatatccatgccttttgggttgtttcaggtggcatgcaaaataaattttttgtctaaaataatatcaaaatagagctaatatgagaaatcaggctcagtggggcatacctggaaaaacacaagaggattgcatgcattcgtaaaaataccacaatatttattgtgtcttatctatgatactgtcattggaagtgtcagacatagaaagcaaacccaggggtaccctagcaattgaatgtctcgagttcatttgactatatgttatctctgattttgaagtaaagaaaccatttccattttcattaagatcccgttactgggggaaggtaaaagtgtgacatttctaataatatagaattgtgtactgtgccagatgtaatatcacagacccatggattttaggcatctgggtctcagctggtcattctgcgaatgcatcaccttacaatattgaacacaggcagggcactcacacatgcaggaagttatttccagctgcatctaagatagggctgtgatgggatggtgcctggctgaatactgagttttagcagaaatctagggggctaactcaacataataatgagatcacatcacattgtgttatgtgcaatttaattttgattatgattggtatgttatcagtgaaattattatttcatttttgaattttgattcattattggtatgttatcagtgaaatgatcattatgaaaatgaattatatagagagtcagtgggtagactagaagcaggaaaggaacttgaagaattaaagtaatagaaatcaggagaggaccatgagagcatgcttatgtatcaagcatttcctacaatgactcttccaagtgagtggacattgattatccaaacatatcagtaaattattaggtacctaagagacctgaaaaagatgattgcagctataaaaatgcacaatttgtttccaagaagtagcatagaaatgaaagttctaacaacacactagattttctcccttttcttgtgtctttctattctccgtacatcgtggataaaatagtttatagaaggaagtagcatgatcagaaacatctccatttaactgtcacaaattggagtgtgcaaaagctaaaattttgtttatttcctgtagcttatcttgctttcaagagactattccaccagcctctagtggtttacagcagtctctttatagaaaatattcagtcaattcaaaaagcctttgtccaaaagagcaactggctaccaagttttaatgccagcacctgctgttgaagttcacgctggttccccttactactaagccctcgagaagtcttttcacctgtggcctccttgatgaagccacagccctattctgattcacaagttctttccgccaagccacccgaggagcctggaactccagctcctttcttcacaccacatagagcctgtgaatctatcttcagcacatgccatagccgttgctgctccgctgttggacatggtgccaggggcaaatgtggagtttcttttcagggctggctattttcaggactgtgctctcgaaacaaaaagaaaaacttgatgtaatggagggttcctaagaaagcaaatgatcttttgcttgatttcttctgcccattttcccaggtactcccaccacgaagggaaatgcaaggccatttgtgtgtctttctctcctcttcctctcaggcctcttggggctgtgcactcaccacttccccttcctgtctgtgagggtctctacctatatcatattctacatgttctctaccctgtagcttttagtaaaacactatctgcagaccagtaagattttcacaacatatgcaaagagaagtttcttctgtttagaaattctcccactcaataaagcctgattttcaatacaatgtctttctagagacataagaaagccagctttgagtctcaatgctaagcaataattttccttgttctagaccagtattctcaaacttgagtgtacatcagaatcacctggaagatttctgaaaccagggattgcttggccccagcagcagtttcctattcagtaggtctggggtggggtttgagaatttgcatttctaaccaagttcccaggtgatactgatgctgctgacccagagacttcactttaagaaccactattctagacacaatcacacttgttcttcaagcagtggatgaccttgacttaatgaactggggagatgtaggaaattttatttaagaaaattaagaaatacaatggctgaatgttttcaaaaagtttaactttatcataaatgatacttaggtattgttaccctttagagcaaggaatcttccccaaacataagaaaagagataatgaatgggaatcagaaagctctgattctataatcaagtactcaactcaaattatagagcatataaattttgtaagataaaatcagagaccagtagagatattgctgctatggcctccgaaagactgaaaagaatgttgacaacaactttgtaaataatattcacaagtatcccttagcatctaattaatagggcttaatacgaatctagctttcagaagttgtataaaaccacctaggccaggcgtggtggctcacgcctgtaatcccagcactttgggaggccaaggcggctggatcacaaggtcaggagattgagaccatcctggctaacacagtgaagccccgtatctactaaaaatacaaaaaaaaaattagccgggcttggtggcaggcccttgtagttccagctacttgggaggctgaggcagaagaatggggtgaacccgggaggtggagcttgcagtgagccgagattgcgccactgcactccagcctgggagacagcaagactctgtctcaaaaaaaaacaaaaaaacaaacaaacaaaaaaaaaaaccgtctaaagtgtgcaattactttttaacttctagggaatttaaagtgtttttttttttttaatcatgatttttaaatgtcaagctcaggttgcagcaggtctgttagattgtggtgacagtgtgaaggagtgggcgttacaatctttgcattcattggatcaaaactgcagaggtaaacctcaccttctattccgcagtacataactatagtaggtacttagaatgaactcaggaaaagaaaggcaaaagacaaaaacattcaaatccaaccatgaagactctaaacttattttgttttgtacaaatgtaggaactgaggcctaaatatacaaaggccaaatattacaaagcttattaatagagccaggtataatagttaagtcttcaaactgtgaggccagggctctatttttataagttggcaatacataaatagatataatcaggaaaaaaagtaaagtgaatagtgtgtattgcttttttagtgagtgatgaatttatataattcaaatctttttgttgttgttacatttatcccacttacaactgaaaacatttattttcaggagcaacaaaactctccctgttttgttttgttttgtttttcagattaaatgcccttattcttgtcatcagagcagcatcagactcaacctgtgatattgtaggagataattgcccttattagtctataattttttaagtgtcttttttatgctgctaagggcctgttattatatgaatagtttacaaatcaaagcacattgccatctccacacaaaaggatgggttgtaattttggacgcaattaaagaaggccgtgaacctttctgtaataataacttttaaaaattaaaatagaaatcaaaccgtttggccccatgctgggctgtgtactttattaatataaatggatactctatgggagttattttaaaaggacaggtgagaaataaaagacctctttttcatgctgcatacttttgcaaactaactctaaactcataactgcctgcttggatacttgtaaatatctgtgtaagtttcagctacaaggataatcttggtatttaagagatgctgaatccgtggaaattatcagcttcctttttttttttttttttttgagacggagtctcgctctgttccccaaactggagtgcagtggcatgatctcggctcactgcaagctccgcctcccaggttcatgccattctcctgcctcagcctcctgagtagctgggactacaggcgccggctaattcttagtatttttagtagagacagggtttcaccgtgttagccaggatggtctcgatctcctgatctcatgatctgcccgcctcggcctcccaaagtgctgggattacaggcatgagccaccacgaccggcctatcagcttcctttgactggagacattgcttctccaaaaatgtgctgaacctgtatatttcccagtttctcaatggggcatttgatggttcctagattataaccctggcatttaaagctacggtaatagtaccacccaaataaagccaggctctgcttggtactgtggctttgccacattctagctatatgattttggacacattgcataacctcagtgccccatccataaagtgaagatagtagtgcccttcccatagggctgttgtgaggattaaataagttaatacaaatcacatacttatgatacggtacttagtaaacactcaataaacagctgaaacttgttattctatcttttgttcttgcgtggcttttttcaatacaactttcagctgcatggtccaccttattccttagcacttaaagtttttgtctttgtccgttttaaatcactttagatataaagtacccttcatgcaagcactcattaaccccaaaacaaaataaaacaaaactcaggatgtgttgcctccataatctgaaaagtctaatattccaaattatcagattgctaaataattctgattgccatttgtcacctcgaaccttacggttgctgtgctgtgtgaagataaactaccccctttagttgctttttgaggaatcatttgactttgtctttctctgagtaaaatctttaaaaatatatgaacaatactaattattctcagaggagattattactctactagatacaggaaaaaaaaagtatatttgccacagaaccattcagccttatattatacatatagttttataacattaatcagttttgctgtcatttttctcatctctcagatttgtacaaatgtaaagtagataaaatgattccccatgatcaagtagttacatgatttagttcacattatatattccccaggttctctctcatgtgtttagctgtcatatgtgagtttggcagcagaatgaactaaggatgtatcataaattgatgcaaatatttttatgtaagcttgttgtatgtactgagcaatagaaactcagaaatacagaatagagattattgcaataatctcttttttagttttgttcagctatagagaaaagcaagaagtttggagacaacaggaaggaggaacttaactactaaattgaattcgtttctataaaaagcagagctagacaagcaaattcactgtctgtggtactgttttcagttgtggttattgtagttttcatatttagagctttctgatgttagcatctttgcctcttgttttcaatatataatttatcgtatttataaaacaagtctggcaagtttgtttacattttagaagtctttcaaaagaaagagaaaatcttattcttaaaaagttgtcatggcattaaccagagatgtatctggcataacccatctcaagtcatgtcggacaaggaaaagttcactgtacgaggccattatcataaaatccagaactgtgctatggtttacatatatatttttcatgtgcacacttaaattaaaaacttctgccttatcagggatggtagcatataaaaagtttggtcaacctttctccctattatgacatgtataccacattacctgtgaaaccaaatcaacttttattcattggatatgaaagctaaagaaaccttttcttaaaactagcaaacaaccttgccaggggtaatttaagcaagtaactcagttcttccatttgcaaattcttcttccaagttgatatattctgtggccacagcatacacagcccagccctttagatcagaattacaatttaactttctttaaatctgataagctctaagaacgatgttcgtacactttgcatggatcatttctgactatcatataaaaacaaggctcctttttctcttccaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttgaatgtgaagcaaacacagcatcgtgatcactgagccatcatttcctgggagaaagaccatgcatttaaagtattctccatcctcccaggaaccgaacatatcatttgtgaagaattattcagtgaatttgtccattgtaaatctgaagaaagttattcttggtactgttgctttgggagacagtctaggaatggagtctcccactgcaacttgtgaactccatcattcatccaggactgagatgcaaatgtcacagtaatgcaagcaaagtatcaaagaaaaacaatgaaattgacctagttcagatacagggtgctccttgtcaatactgagccatttatacctttgaaatattaaaatcactgtcaatatttttatttttaactctggattttgaattagattatttctgtatttggctatggatctgatttttaatttttttaaatttcagtcaattctgatgttactgagatgttttaccatccttacaatgtaaaccacatgaactacgtgacctctgcaagacaaagcggctttctaatagagagattagtaaatatgtgaagaaaaagacctgcatttggcaggaagatgtatgctttgaatgcaaaagaaatttagagtcaatttgctgaaaacattacatgctcagcttggttttggacaagcctgtccattgggcaggacctagctgttgtaaagaattggtcttaatgttgaatgtattttggttgctgatgtttataaactgagaggtcacaaagaatctatcactaaaaatttttacaaaactgccaaaaatataattcttagtggaagacaatactccctttaaagagagtttgccactcccctaaactccaggatttataaagcaaattactccaaggtttataaagcagattacctcttgcccttgggtgctatctagcagtaaaagataaatttgttgaatattggtaattaaaagactccacataagtccattaactgctttccacccagcttcaaagcttaaaaagagctcaggcttttccaggaagatccaggagggctaattagaaatcaacttgtggttgaccgcttgtttcttgttattaccaaaacaggaggggaaaaaattaactgctccaaatttaaccataaatcaattcatgtttaacgtttctcattaaaatccagtattatattatcatatctctctttacttcccagtataagatttttgaaaatcctgaataaaccagtatcgttactggcacctgaaattaatttgtgaatttgcaacagtaatcagagttaccattatttaatttgtatgctaaatgaggaggtacattgaaaccctccaaatctccagtctcatctatgtcatattttgccactgcctttcagaagtgatttagttgtggaaagataataaattgatttgttatggttacatatttagcgcacccagagaaaattaattatatttctacagagaaaatgaatttgggatactaaagtagtttaagtctcctttactgaatgtaagggggggatcgaaaagaaggtatttttccaatcacagtgttatgtagtattgttctatttttgtttacaaacatggaaaacagagtatttctggcagctgtggtacaaatgtgataatatattgctaaaatattttagatgttattatgctaatatagtaggggttgaagaaaacaaaatagcttattatagaattgcacatagttctgcccaaattatgtgaaatgcttatgcttgtgtatatgtataaattaatacagagtacgttaaaagcaaaaagatgtatatttgcatatttttctaaagaaatatattattcatcttttcattcattcatctcgtctcctgctcattccatgctgtttttgatttcagccatgggctgctaccatcccatctcatttgtactgtaggagtgggaaagataatctaaaagcataggttagaaaccatacacaaaaatatcaaggttattatctttattagtacaaacatctttagtctcaatttgattgtaaattcagtgacactgttctcatgcccttgataacacaaaaccacacaccagtgtcaatcaatattgcataggtttaggaagcacagcaaagaaatcaagtgtaagaaagtattatatccttttattgttcttgtttttttattcattattctgggaccagacttgatctgtccaatatcacatcagatccttagaattgttacaatcaatcattggcttttaatatagtttggaagagagactaaggctagacgaaaggcaaccaattaactatcattagaatgcataaagcccaccattggaaggattttcagatctggaaagcatgaaatggaaaaaatgaggattaaatgagaactctgatggactaaaaaggggaagaggcgcaatttgtagattcttctcattacgtgagaacatccaaaattgtggcctcatgagatctgggaaacttcttccaaaaggatatgtaaggattacatctttcccttacattccacggggaataccgatagatattatcattgtgatcttgaggaacaaaaacaatatttcgcatcataccataaaacatgattcctcaagagataagtttgtactcagacggtcagcttcccttttgctttgactcctattttttgatccaaaacaggcctttaggtgcaaatgaatattacagttactgcaggggaaaatgttggaaaaaacatgacaaaaatgctatcatccttgagctacaatcattctcattcattacttcgttcattaaacatcgattcaacagatgtttcatatgccttccatcctgctatataacaaatatttattaatggtagttatcaaggcaaacgttctttacagtagggactgcttctttttggtgcaggggtaaaaatcaaaacctgctaagtgaaccattaccctaaaaccataaccactgatatcttgggggtggaagagcaaagtgacacatgtggctggaggtggtagctgagtgtgatcttccctcctcattaacactggacataagagctctagttgtaagaaacattctcagaacaagatctcaggacaaagtctcaagcaggattcactttcttgacaacaaggtctacaatggtggttctttcattggttagattacagcttaactagttatcacaggagttaacacttttgggtttaaaatgaaattatttatgaagagggtagatcagaatccatatttagaagagcaatcaagtaaaagcaggaaattctatttgctattttgacagagtaaacaagatgacattcctaacttaagcttatgaaagttgatttactgaactaataactcgtatcaagcaggaggttacaggaaacaataactggaaacatgcagaaaaggatgataatatgtgcatgtgagggcaaaggaagatagagaagcaacatttgcaaattaagaactaactatttctgattttttttcttctggacgtgaaattaacattttttaatatctctgaataatatgaagcattgaaggaaagaaaacacagtcattgaaactgtaaccaaaaaagaacaggaagattttctaatatcatatcttcctccattcagattagcaagcatctctgacaattttcagagattttctattatctgaagcattggtcagccagtctcttaagtcactaatcaatgcccattttccatttacagaaattcaatgccttctatctagttttcccagaaatccttccaatgagacacaagctatgccatccctcttcacctattgaccagcaatgtcacctcatgtcact

SEQ ID NO: 33 - DNA, 10544 bp, Human; identical to SEQ ID NO: 28

SEQ ID NO: 34 - DNA, 312972 bp, Human
  misc_feature (1)...(312972): n = A,T,C or G
ctcagggcgggcggctggtccgggaggccacgccagcgcgacccagccgagtcggcccccagcccgggcccccacatttcctcccccggagggagggaggcgactctccgcgggctgccctccccagcgcccgccgcgccctctggcggccgccgcggggacgcgcccggggcacgcggcgctgcctgtctgggccccccttccggggcgcggggcccgcgaggggcggcggggtcctctctcctcgagccactctgggccgagccacacgggccgcgcccttccccctccgctccccctgagcccccaaactccgggctccacggtcgcaacgccgcgggcaccccagcctggcgtgaaagtgcccggcgtagtagcctgggggggggggtcccctttctcccaggtgcgccccttccgccacgttcgggctttccagtacgcagcgaaaaaaatgccgcatgcacgcatttatttattttgcaacagctgcaagaaacaatgaagcttttcaagaaccggggaaacgcgctttccagccgcgctgttgttgttttcaatgaacctctcccagccccgcactccccgcccacccctcccctctcctgcccacccctcccctgcctagcctttccctggctacccacccctgccccgccgagaccggaccggcggcgggggcattgtttttggagtcgggcgggaggggagggcgcgtgcggggtggccggcgcagtgcggtgggggcgggagcgggtgggcacgcgcgcgtgtctctgtgtgcgcgcgggaggcggtggggcgggagatggggggcggcgcctcgcagtctcgcgccccacgcccgggctccgctccgcacgtcttggggaacccgggctccggttttttgcgcgcgccggcctgggccgggccctcggcgcgccgctgctgcggcggtggccgctcgagtgtgcgagcgggcgcgtgtgcgcgggccagggcgcgcgcgcgcgcgcgcgagcccccagtgtgtggcagcggcggcggcggcgcggcgaggctggggctcttgtttaccagcattaactccgctgagcggaaaaaaaaagggaaaaaacccgaggaggagcgagcgcaccaggcgaactcgagagaggcgggagagcgagagggacgccgccagcgagcctgcccacggccggcgctcgcagaccctcggccccgctccccggatccccccgcgccctccacgcccctcccgcgcgggggcagctccacggcgcgcctcgcctcggctgtgaccttcagcgagccggagcccccgcgcagagcaggcggcggcgggcgggggccgggcgggggccggcgcggggcgggcggcggcgcagagccgggcggcgcggcgggagtgctgagcgcggcgcggccggcccgccgctttgtgtgtgtcctggatttgggaaggagctcgccgcggcggcggcggcgctgagggaggaggcggcggcgagcggagccaggaggaggaggaggaggagggggagccgctcattcattttgactccgcgtttctgcccctcgccggcctcgcctgtgacccggacttcggggcgatcttgcgaactgcgtcgcgccctcccgcggcggaagctcgggcgtccggccgcctcccgcgcggccagggccgggcttgtttttcctcgcctaggcagatttgggctttgccccctttctttgcagttttccccccttcctgcctctccgggtttgaaaatggaggccgacgacgccgacagtccgccccggcgcgcctcgggttcccgactccgccgagccctgggccgctgctgccggcgctgaggggccgccccgcgccgcccgccccgtccgcgcacccggagggccccggcggcgccgccttcggagtattgtttccttcgcccttgtttttggagggggagcgaagactgagtttgagacttgtttcctttcatttcctttttttcttttcttttcttttttttttttttttgagaaaggggaatttcatcccaaataaaaggaatgaagtctggctccggaggagggtccccgacctcgctgtgggggctcctgtttctctccgccgcgctctcgctctggccgacgagtggagaaagtgagtatgtgcccgccgcccgcggccactgcgggaacttttcctccgaggggctgcgccctgtttgcgaaacccgagttgccaccgtcgcagctgtcgggcccccgggctcgggagcggcggggtggggcgcagggcggctctgccgggagggaggctgcagcggacccgggacccgggctcgttcgtctggagccccgcgggccctggctccgcgcatccccgcgcgggaagggcttttctctttctccgtcctgacagcccagccgtgtttcccggctaggcgcgaggactcggtagggaagttggtgccggggcgggctccgcggttcccgggccccgcgacccgcacctcgccccttccgtgcgcacgagcctctccgcacacagcgctgatccccctgcggcgcgcaggcagcagcgacagcaccctgggccgcaccgcgtctccgctgctggggctgaccgggcagtggggagcgggcagccgcccggcccgcggggtgcgagttgccctcgaggggggaggtgccctgcggagaggccccgaagccccaggacacgtctccaagcgcccgtcgctgcctcccgtcgcccaacgtgcttttgcccctcgggctcctcgggttcctggccttgcccgtcactttggcccgctcctcgttgggttacctgcccccggcgtcccggggctgggcggtggggtgaggggaagcgctctctgggcagccccccgggaagtgcgaggccgggagtcttcctcagcttgtctcttccggggagcgccactgggtccccagttcagagggctctgggatggtctcccagtttctcccgggccgggggatggaggggtactagggccgcatccgagtgtgcgttggtgggtgtgtggtcggagccgacgtgcattccgacacacgtgctcgcagcgcggggtgtagtcgccgcctcacggggacacctagacgcccgtccctggcgagaggtgtcgtacgctgtggtttcagcgccagggtctgcggcggcgcggggagggtgttgtgttttgcgagcgcggagccctggccttggttttgttgtggtcggcgtcgtgtcgccctctcttctgccgccccgcacttcctttgtacgtagttaataagcagtgtcgctccacattcgctgtcttttgcaatctgatagcttttgttttggtggtgtcgggtgggggttagtagggaagcgcggggatgcggggagcgagaactccccccggtgtctacggccggaggaggtgggggttttattcttctgaaaaagttgaaagtgtggcttactggtacattcaagatggtagggtaatttgaacacgattaaaagtttaaatgtcgcagaactgggactgggaacggtgagggcgtgttggtgagtaatggttgccgagggtatgcaggtggtgccgattaactttgaaaaaatcacgactgagccttcacgagtgaggcggggaaggaggaggcagcggaggttgtatggccccatcaccggggcaattcagaaaggctgtttctataaacaaatccttaaacgtctggtaagaaatgagtccgcgacggaacgagagcagatcgtggttcgcgtgtttactgccgagtgggacgcggactggggccggaccttccacagatctgggctctcctgctctttgttttctaaactttcagcggactcgattgggcgaaagccttccggctccctttactaagtcgtttaggtggtggctggggggacaaaggagggtttttatctttaaaagataagtacggtttagaagacacgggagaaataatccattttgttatgttatgcagttgaactgtatagcttctctagttttgtgtttttaatgttctgaaattcaaaacagcagggatggccttcgccgacgcaggagtcgggcattttaaaataggctgtttttcttttggagcgttcttcttgaaggatattgtttgtgcaagacggcgatttttgagaacacaggcaggagggagggggtgttttaatgtatgtttttactccatgataccaaagcttccccccaggatccctttacagtggttagttcctggaaacctgatgggtggtcagaaggcaccccaaatctcgattatggtttgctgaagtcttgactgactcagtacctgcccctccctccatctctgaaatgtggagaattaaaagctatgcctgtgaacgggcgttcagtttttagccgggaaggtgctagaccacttaactctgatagaaataagctgctgagccctatcagggagggcgttctttcagctgttgtctggtggagaaataaagacagggtgttggttcagttgcaggtattttgctggcgtattgagagattagagtttcctctttgagtgtgatggcagtagaaagagtgttgtttatcttagaaaacttagtttctgaagcagaggcagtcatatggatgtgtttgttttgtatcaccataatgtgaacagagcatctaaatgaaggcggttcggaggttctgagtgatagccagataatctgagggctattttgtttttaaaaagtcagcatgcactttaaatttattgtacccatctccttaaaaggattcagtcatctttctaccccaggcatcctgttgtcacagaaatgtaggtatgtgaaatgttggtgtttaaagaagttagtgttttattaccagaaggagaacccagaaaaagaacttctgaaagaacctaaacagcaaattatagtttagatcctctggagagacatagcaagcaaatggtgttttgtggaagggtggggtttgtgtcaggatttgaaatgtaaaaggtcataatgtttgatttgtcgaaaaagattagaaaagttcaactctaagaaatatgctaaggttgaatagatgaagcttaaaaatatcacaaaaagtgaaagaagtcagtcacaaaagaccacatatcgtatgatccggtttatgtgaaatgtctagaataaacaaatccatagaggcagaaggtagatgagtggttgccaggggctgggggcggatggaatggggagtgactgctagtgggcacagggtttctttttggggtgatgaaaattgttctaaaattagtttgtggcgatggctgcatagctctaaatatacttaaaaccattggattatatactttaaatcggggactttaatggtatgtgaattatatctcaataaaccctttttttttttttttaaagaaatgtgatcaggttgaaaataacttgttatgctaccttaaattacgttaaaattattacatatatttgacaggctgatgtctctctctcttttcatttatgagtttttcagatccgtgagttgcagcaatacaacaaactgataattgaagcttagcaacagggattcaatcccgcagtagaaatgggcaagcaggagaaaaagaatcttggttctatgtagcttcagttagggattgaggagctggatttaaaaaacacaaatgctggtggagggcagatttttgacaatagaaacctcagctgaatctgaaatgatggtttttttcaggatagagtttaggagctgagtctgaagggctgtttgtatttccagttttattatgttttccaacaaagaaagacattgctgttttaagatgttttaaacactcattttttgatatgccacattgaccacaagtggtagtaaggactgaggatgaacagaacagttcattttaatgcagtattgttgtttcttttctttgcagttttattttatttcttacatagttccagggtctgagcaggagaaagaatctttaggatgcagtagttttaggatacactgtttcaagtatacagtgatttttataaaattaaaattccttacagaacgaaaggttttaaaatgtggcaaaggcatttttgttttgaaactgtgtgcatttatccagatttaccctggcctttcaataggaaaagacctagagaataattgttgtttacatttgcttttggtctttgtctaaggcttagtttactaataaaaatgtttcctgcccttcctattgttgcaagatcagggcagtaatgaaaatcaactgtatcattttcacttgttgccttagagtttttgccaagaggaaccctcaagggacggtggtttccttttaaatctggtttcatttgttttgtaagaatgtgctgtaagaagcaactgaatccagcctgcacttattgtgcacctactgtatgaaagctgaccttgtgctactcagtgcatgaacctgcagagtcttgcatgaaaccacctttcttgaaattcagattttttttcagactcagtatagggtgcagttttcaagtagacagtagttagcattttaaaggttcttttaaaaatatttctgtagacttaggactctagtgttgttcatcagaagcctttaccctataccttttttgcctcattggtgctttccgttatattgggatgtcactgtagactgtgacatacaggtgatgttaacccatcttgactggcggcactgtcttctttataacattggatatggcaattgtgatttacaaactgcagtgttgtagttgcctttttccaaaaattaggagtcacaggtgtgtacatgaacgttgcatagcatgttttgagttgtaagaaagatggaacttatttcagaagttttctggattacatattgcttagttagctttctagaaatcaggaagcattcataatttcagggcattttataatttgtaaataacttggtgtttttaaaagcgtgagggagtaagagtgaggagacaaatcctgaaagtttttgttttttaattgtaaagcatacaagatacatttctttataggttgtgattttccccaatttgttttcaaaactcatttaaaaatcagacctagttcatggaagaggtatttgcgcctgtgggcgaacttgatttgaactgcttttcttagccagcttaggacaggtgctgagtccaggggatgagctcttctcaattgtactaaatatataatagttgcacacatgttacggatatagtttcttgatttccagtctgagatgttctgaaggaaaattctgaacactttagagacaacaaagtgcctaatgagtgatgcactctgatccctcctggaaaatggtgtttggcatcagcttagcaagaggaggttttccagttatttgtaaagatgtgatgtggctttaagtggggatgggggagggtagcagccccagtgtttgtggacattgagacctgttgacatttgggaagcataactgagttccactatttgaaaagattaaaactttgatatatgtacacatcccctcatgcctgcacccccatccccgagggtctggaaaagaattgatttgttctgaggaaggaacatatatttggaatataaaatggttagtaaacaaaggatctttaaaacaagttagattgttatctcaagagaagcatacttcctcggcatgatgttttcttttgttaaattgctttggttttatttgactcaaagtattaacaatacctttgattttgagacttttggacttttgaagactaagtttttaaatggtcaattttactcgtttgaaagtcccagataccatttttgaagatttctctccctttttttccactgatgccggctttacttatgttttattttcaaatcttaaggaaaaactgatatttccttacttgaactgagaaatagtcgttttccctccctcttttcttccacagtaaatacatgttgagtacttactggatgcagttctttaggtttagaaattatttgatactgtaaaatgtcttaccataagtttttaaagatacccgtcaaactatagatgttactgccatgtttattaaaaaaaaaaataaaacgaaacaaactagtaagcaagcttaaaatttttctttttcctgccctggactacagatttttttttcttttttttttttgagacagggtctctggtcacctaggctggaatgcagtggtgtgatcacggcttgattctgccttgacctcccaggctccagtgatcctcccaagtaggtgggactacaggcacacaccaccatgcctggctaattttttgtatttttagtacagacgaggttttgctatgttgctcaggttggactcaagcgatccactcacctcggcctcccggagggctgggatcacaggtgcgagccaccacccccagcctacaagaatttgtaaactcatagattgctcttctgttttcactggaccacaacagaaagtagtttcttttatggtgagggatgaacacctacgattgcaatataagttgttgggccttgtgtccatggagctcacttggtggttggtggtcttgaagcattcacattctttggagtagtggggcggctggctagtcacatggggaagatgtgcacacctgtggatggggccatcacacactgcagcgatagctgggcctaccttactgctcacctggctgggcacagcggctcctgcctgtaaccccagcactttgggaggccaaggtgggcagatcacttgaggtcagaagttcaagaccagcctggccaacatggtgcaccccctttctactaaaaataccagaattaaccgggcgtggtggcccgtgcctataatcccagctacgtgagaggctgaggcaggagaattgctgaaacccaggaggcagaggttgcagtgagccaagatgatgccactgcactccagcctgggtgacagagcgagactccatcacacacacaaaatacatatataaaaataaattgctcacctggtaatagtctggaaaacattttttttttgtttttttgcatattttaaagactttagaaagtagtcttgctaatccagaaagttcttgcggggaggagtttgaaactttgttttatctcactcctcagtcttagcccccttaataccataggtctctacttcagtaagagttacataatacgaatgccgtttgttcagaattgtgtatctccatccatccgtccatcgtccaaattctgcaagtttgaaatacattgttgttgctgttttgtatacttttgttcaaccattttctttttaacatggcactagctttctcaaactggctttggaattatttgtcagtttaaaaataaataccactttaaaaattactcttgacatgggagaacaaatatattttgatagttgttagagcataaatattttatagagcataacttgaaatttttcctgatacattgtgattgctttcagcttgtcctctgctgtaaaaaatatagtcgtggttagtctctgtaaagttggttattgggaatatgtgcttgattacgtaaatgagacatcaccaatttaagtcagccaaagtttagtcaatagaactttaaagaacagaagtctaatggtaattagggagagatgaatttatttgtaggagttttccccaaattcaaagcgtcttagtgacctttgataacttcctggaaaaagtaggaagcatggagagaaattccaggtaggagcccatgatccaattgactgcatcagcttacaaagtgttttctaagtcattagctattaattctgtctagattgtaaaatccctctcagttgtgtccacatttatctgtgttgtcctgtatttattctctttacctaatttccctgagtctcattttagtgggataatacacaagcttacagactcaggactttaaagagaagcacagattgccacgaaaacaaatgaacacagagaccagtagcagcagagggagatctgctgtgaggcttcccttagttctgttgtctgatttctgtggataatgagttcactgcatatgttaggtcacaacatgatatcgtgtagtcgtaggtacagaacttttgttatggtagcctttcttcgtcaggtgatacaattgggattttctttctcacatgcacctcagtaaaattttcagcaacagagattggctcaggatggaatttgttcagtttcagttctgcagcctgtccttttctggggagactcattaattgaatgttgcctttcgatctcactgagtcacttgaaatcgctcagattgacccctattccgggatccagcctggtccagtgcagacctgcattgactctgactacatgctgagttggcctctgaaccagttcctgtaccattcccttagtctgatggacttgccagctccaaatactcagaacgtgcctcttgtggtcctaggatcaagtccagggtccttagaatcaagtaatgaaacaggtccttagtaatcctgtgctgtagggatccactgttagttcctggtactccccagcatctgtgcattagcttgatggaaaggaagctgtgttatgcctgtcttcaagtttttgcttctgctgtttccatagctgagaatgtttttcctcttcactactctgctacttctccttccatcctcaatactgaatagcagaaagtgccgcttaagaacacaggaaggtcaccatagctttagtttctccttagctgccaattagttctttggtcctaaagttattaacttttctgagtcttgatagaaatgcggagacttaaaaatatttgggggagacatttctccttttctcactaaacaacagaatgaaaaccttttctaacaggtttagaaaaccaaagtcagaaaaattgtgaggaaatagaataggttttttaaattgaaataatttccaagttccaggtggatctgtaaaatagggacaagatcataactttcaaaaggcagcacgctaagtcaggtgattcctttcccccatatgccttttctgtggtttgaataggtcagagatgccatctttacatttccaagtcaaattcctcttccttcttgaaggtttttgggatttccctaacttgtatagatctactttcccattactccttttgagttcataacccacggttttgctggttgacagtgatttgtcttgttccttgcttgtaattttattaggaccatggagccaaagtggctggtttgaatctcagctcttcagtagctaagctctcaggcaaataatttaatcttcttgtgcctcagtttcctcatctgtgaaattataattttaatagaatctactttaaacattcatagaaatcaaattcgtacacatgtcaagtgcctagaatagaacctggcacctggtattaagcccttggacttcaactgctactgttcttagggttgtgacatcctcgaacagagatgttctttggatagaaatataaggcttacttgatgtttgattgtccttgccatttaaatatgttatagaacctggcacataggtgctcaataaatgtataataaaactttattttgctaaggtgtttattaacaagatggcatgttgcttattaaacagttgtgattttttttttcagtaaacgatggtcatccccctgcagtttgccttccatttcagagatctgtttattacactttctcccttaatattgtcatttgtcaatttctgctcacacctgagaggtgtccagtgtgcactttgcccatctcgcctatgcataggctccatctagtggccagaagggaaattcagcatattaggtgactgaattaatagtgccccaaggaggaagatagcgatcccaacccactctctggcttgcttcctggggactgattgcaagaaaatgtggatactacagacttctgtagaaatcactgggctacagttttggattaaggttactctactgtgtcagtgcgagctgtcctgagagaattagggtcttcctaagtgatgcagacaggcgcactgcaactccatggcagagctgttaacacctagtgtgtcttttacagttagagttttaagataattttacaggactttaataaatttaaagctccaaaatatttgagattagagattaaaaaaacactactgatttcatttggaaaaatacagcaagatttaccttccattgctctatttaaacaggtagtaacactttcattctcttctctctcccctttggctattctatgtggttaagatgctcgccagccagaaatactcacagagaataagaataaatacatccagtgttgtgttaggtcccacaccgtctatatttcgctagctaattttatgtattttgtttcatgttttattgatattttcagaatctttcttgctgagattacacaaaatatatagctggttattcagttttacgtgtcaaaagccttaaacctgtttccccatgattgccttttattatttttaattcggaaatctttgtttggctgtctgagagagaacttcagcctcccttcctcccagacattttgaacagttcaggctgtactcattcgtgtctctttgtcttggcaggtggaagcccctctgcttggaatagcaaacaatactaccagcttgccctctggcaagctcctttaagagttagctgtaatttcaccctctctctggccttgattctgcatgcagaatgattgcactgacttgagctcctgtggtctcttgctatacctcctatttgggcatctcccccatattgctttcccccaccattggggaggggaatggtaccttggttatctttgaattcccaggaggtggcccagtgcctggtgcataggaggagctgaagaaacggaagacttcttaaagggatactcgccattcactttgaagcacttctttgtacaacaaatttattttcatctgatcattgcacctctgctagccaaaacattttatcacaccagttactgctgcatggaacttgaaagcaataaaattatctttaaaatcattgtttgattaggctttttgcacattgaggtgaataaaaaaaattagaactcctggaagggtaatttgtgagtctggccttgtgtcaagatcacctcatccctgtggatggagactttgttccataagttccctatagataagatgtaatgaataattcattggcaccgatttatgtctgtagtgtgcttttaaaccctcctggagctgggttcctgaggaggaagcatctgcaggctggactcggctgcctggtggtctccggagtggcctggtgcagagggccagggtggcatctcagaaagttgggtgggtagggtacttgcacacctgctgaccttgagttacagggtggacctaggtcatttcacaggcccttccagccttcagatctcaagatactaggcagagagagagatggagatttgagggagatgtggttggaacaagcagaatcaccacgtatggaagttggcttctattttttgcattgttttcttggtgaggccagtaagcttttgcctcactcctgggagggacagtagcaaggtcttacaggtctctctatcattgaagcaccctctccaaccctgccggttttggttgctggtgaaggcctttgacagtgtcctggtagggcgacggtgaggccagctcccgacctctggacagaagaaagcttacttgtctaggttggtgtcaaggggactcctgaacttaatgaacaccttagaaattatccttaaagtctcctcttccgaggagtggggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctcccaggttcaaacaattcttgtggatcagcttcccaagaagctgggattacaggcgtgtgccaccacgcctggctaattttttttttttctagtagagacggggtttaggcatgttggtcaggctggtctcaaactcctggcctcaagcaatccaccgacctcggcctcccatagtgctgggattacagatgtgagccactgtggctggccaaggagggtctttttttgcacatctacagtgaaaggtttgaacccggacgtctgagtctcaggtcagttgttgaaaccactaagtaaccaccttgcttctctgtgcctgaagagaatgggtttttaggttaaccaggctgactggttcaaggtcatgtccctatctgtggaaggggagtgggagtggaaggtgagtggtgacagagtatggaaccctgtttctgatatctagattatttgagggcctccagtggtctctgctccatggaaagcatatgaaagaatatgattttttttttttactcgagcttgttgtctagttgggaaaactcaactactggtggagagtaacagatgctatgagtttagtgctaagttatgggatgctgaccggagagaagtatgtgggctgcaggcagtggggtcacggaactgcagaatggcttgagaagctttaaggaggatgtctgactttagtgtgccctaaatatttgactctcaagatccaaggaggcagctccccaggagaggaagggaccatgtgtggtgtgggtggcagtgtgcactgatggagtggagagggtgtcagaatccggtgtttgtgtggtgggaaggaattgactgctggctagagaatgaggagcgctgaaacctttgcaccattgcagtggacccgctgagaagggtgttctggggaggctgctctggtctctcgatggagtcaggattgggggacagatagacaccccggtgtgagccagtgatggtatagatgagggaggcagtgaggacaggctcagggagggaagtcttgtctctagacctgagaccaggaagcaggaatggactggacaggttggcccagctgagggaggtgactggtgagatgggtcctcggtgtgaggggctgggttgccagaggagctgtgggctggggtggtttgtcgagagagcagtcccagttgatggagaggcaggacccgcaaaacaggttggctgcaggactgggggcggtagcacagggcagctcccgaggagacacctggcacttttaaggcatggaatggagagagctaggggagagcacacctgcagtgaggcaattcacatagcaaagttctccggaaactgcagtgttcaacttttttaaagaatagctggatgttagaaaagtggaggaactgtcacctttattaggggcatcatggatacctggtagcatcaagggctagggttaaaacccgtggagtaatacgccctcctattgtgttcctctcctctaaaaatgaaggtgaaactgtttcaggtgagcgctgttgttgttcgtttgctggggcactgctttctgatttttagaggagtccaggctggagactgacccctgcctttttctgagttgggccggctgggcccgaggctggttctgggctgggccaggctgatgcagtggccttgggcttcccgaggctgggagagggcggtggcccccgctaccctgaagagctggccaacgcggcagggctctttccagtccttaccatgcaagtgaagaggaacagtttgtttaaagaggggtgccagcttcacatccaggcctggactttgctactggtgcttttgaacttgtgttgatttatgtttgtaaattgactggacacattgtggttcttgatgagaagcaattgcccatccttagcccacgattagtgccactctctgggtgctgcctgttctgccactgtaactgttttcacttgacaaataacattaaaaaacacagttctgcaagagacttcctgggagggtggtatcatttggcctgtgggcttttgtaacactttcctgctattaggagagtgaattctgaattttcaatcacgttcacctgttggagcaagtagagtttcagacggtctccgcttttctcgactagaaagcaggccttctcccttttccccccagtcttgtttcatgacaccattcccctctgagatgagggttggagaattagaagtctactgatgcattgtaccggggcacgttattgaccctctctgctctcctttcctcatctgtaaaatggaagataatgccacccatcaggccgagtgcggtggctcatgcctgtaatcccagcactttgggaggccgaggtgagcggatcacctgaaatcaggagttcgagaccagcctggctaacatggtgaaaccctgtctctactaaaaatataaaaattagccaggcacagtggcatgcacctgtaatcccagctactcaggaggctgaggcaggagaatcacttgaacctgggaggtggaggttggaggttggaggttggaggttggaggttgcagtgagccaagatcgcgccactgcactccagcctgggcgagagtgagactccatgtcaaaaaaaaaaaaaaaaagtgtcacccatcttggaggatcgttaccaatacttcatgagtgaatacatacacatttcttagaacctagggtttataaacactaggagttagctgatactgttgttgctaaggatagaggaaatacgcattagaagttatttacttcctttaaaaaaaaaaataccctttgggtgtgtattgattctgatgttttgctcctagctacatttgccgtttttttttgactgcagaattaggaaccagcttcatttttttttttttttttggatggaatctcgctctgtcgtccaggctggagtgtggtggcgcaatcttggctcactgcaagctccacctcccgggttcacgccattctcctgcctcagcctccccagcagctgggactacaggcgtccgctgccacactaatttttgtatttttagtagagatggggtttcaccgtgttagccaggatggtcttgatctcctgaccttgtgatccgcccacctcggcctcccaaagtgctgggattaaaggcgtgagccaccgcgcccggcaggaacccagcttcatttcttgtaaagagagtttgacaagcgctccactggggatagcagcacagcttcctccttttctgtccctgtctccctcctgactctgcatctgcctccgtttgaagcatcctcctccagtaagtgggtcatttggattccaaggcccttttgaggccatggtgatggatcatttgcgttatcaatgtgaactgtggatgtcccttcgcccttcagtctcttccttcttcaaggagggggaggtaattgggggtcatgtggcctggggaagagcctggtcacgagcatgagggatgtgagtgggactatgtttccagccaaaatttagggcacaggatctgaaaaacacttagattaagtatctgcaacacaaattagggtattttaaattgaatgtggagaaccctgagaacctgtgccctttgtgcgtggatggctgcttgcaaggatgagcatccccagctggagcggcccatggctgccagaacaggagaaggcttcagtcaggtgggaagccagctgcagtgtgttgcctgatgcaggatggtgcgagaaggagctgctctcttgctctgctccctggatcgcacaaggtcttcctgagaccagaattcaaggttagtcctgtttaggcaacttggtagatggacttgaatggtctttgctaagcgaatattgcctatggtggtatttgcaaggaaaacaaaagtgttttgagcccagactaaccaatttaacaatgctagtaggtaaggatactactgtttgctttctgtgatgagaggtctcttaggaggaggggttaattcttttgatttaaaacttactacttgaggcaaataggcacatgaaaagatgttgaaagtcactagtcattggtgaaatgtaagtcagacccacaattggtacttcatactcattagtatggctattaccaaaaacaccagatgatagcaagcataggccaggatgtggagatgttggaacccttgtgccttactggtgagactgttaaaatggcacagccttttttttttttaacaggaagatgatatggtgcttcctcaataaattcatcatagaattgccatatgatccagcaattccactttggggtatatgcccaaaaagaagtgaaagcaggggctcgaacagatatttgtacacccatgttcatggcagcaaataattcaaaatagccaaaaagtgaaagcaactcaagggtccatccatagacgggtggataaacaaaatgtggtctatccatacaatggaatatcattgagccttaaaaaggaaggaaattctatgatgtgctacaatgtctgtgaaccttgaagacactctgcgaagtgaaagaagccagtcatgaaaggacaaacagtgcataattgttacccttacgtgagctatgtagagtagtcacattcatagagacggaaagtagaatggtgaggggcggtgaatagaggctggggggagggagcaatgaggaattggtgtttaatgggtacagagtttcagtttgggaacatgtaaaagttctagaggtggatggttacggtggttgagcaacattgtgaatcagtgtcagtgaactatacacttaacaagggttaaaatgttaaattctttgttgtgtatattttaccacaattttaaaaagcttatttctcaattgtttatgcgagtatatgtgtggaatagttggggagacaaattcaaggagaccagtccttgtccatggcggtcctaggtaccacgggatcactgcgggggaactgtgaggtcaggagaggccttgaaaaaaaacgcaggtttgagctgagtcagatggaatgggtctgttttctatatcaagagacagtattgcagataatttttttctttcaaggaaagcaagtcaggagtcaaactctcatgccaccgtagtcacaaatgaaatttattgctaatcagccatgtgacgtgtaattgctttttcattttcttatttttccagaagagagatttgtttagatgtttgattccctcactgattatgattatactggaagtttttcatttgttttgacagctcaattttttttttattgtaaatggactccctcattacagaggggggagcccttgaaagaaagggattgacctctgcaggcaagaatctgagcatcctaaaagtagaaaagggctagaggcttcgccttacaggccaggaagcttggagggacgcgctgctagagaccatggcacgcatgctgtgtgtcgaaggccaggtccgcctgtctgcctctccagcagatactctctggggctatttttttctgcttggttgtcatcttttggtttaaccaggcgccagggctcaggcctggacctgctggattccaaagaagacttcgaggtggccgagcttgtctggcttccagaggagctttctctgtcccgcccgggggagtggctcaccttggtctgagaccaatgggaggaagcctgctgcgggcaactggtctgtgcctggaagttggacttgcattttctctggacctccaaagcaaacccgaatgaccactctcatcctccccttttgcttgtttgtgtatgtgcttgttttgcctggtcgtcaggcaggaggtggtgtcagatgatgagaggtgttgctcgtccctgggttggttctcttacggggctgtatggatgtcttagctcagactgctgtgacaggttactatagactgagggctaaaaccacagacttatgtttctcacagttctggaggctggaagtctgagatcaaggtgccgaccaaatttggtttctgttaagggtccatttcttggcttgcagatgacaaatgtcatgtgtcctcacagggtggagagagcaaggggctctggtctcttcctctttatgtaagggcattgttgccattatgggggctctaccctcaggacctcatctaaacctgattacctccctaaggccccaccttcagataccactgaaggtatctgggggttggggcttcagtatatgaattggaggggacacagtcatgcagttcagaacagtggagcagtgtgccatagtgaagggatctccagaccaggattctctatggaagttcttggccaggtctgagagttggttacagatcattaaaatttacatggaatccagtacttgaaagtacatgtcttcaggatggcgctgagcacattcgcctctgtaaccaaatgcctgaaatgtgtagtgcaccttctgagcaccccagtgctttccttaaagtgaatgcagtttgagaggaactcaattattgagaaattttatatgaccccatttctctcattttaggacagataagttgcttattttaaactctgcaggagctacatagaggaagttatactccaggagagcttaaatttcactctctgaaaactctgttccatgtaagtacattcctcctctctcccctcctcagtgagcacgtacccatcagatgtgtggaattctattaaaagcagctcctcgtgaccctccagggttttgtaaagctgacaccagcatcagtgagttggaaggggctgccacagaagacagacttactgctgcagcccgcttcagagccctcagtagtactttttcctctcccagcaaatccaggaggctgggaaggtgattgttaattgtttatgagcattaactgtttaccagtcatacttactattttaaatctgaccctgccattatgttgttttgtttctgttcacagctgagctttaagctgggtagaatttcgtgatgagtcactcctatgactgtaaaatcagtatcgatcaagccttcctgttcatcctgtgagcagtttagagacagatgagacaggcttatggtttccactggctcggctccgtgcgtgtgcggattgggcttcctgagagcctggttagccccttttatctgctctctgaaacctgcgcaagggtttttagcatgcaccttgaaacctctgctgcctgaagacagtgtgcttaaatgaagggtatacaaacccatgtgaggttttctcttcccttttccatgaactccaccccaattacctgtttgaattttgcatgccagttattttcagggaactagtgacccttttcttgccaccctgggctttgaattgaaggccagtgtgccaccttttctttggctttgttagaacgttgccctcagggtcatatgtgctggctgctatgaattcttactgcttgatggacagagaaaggtgagggttagatatctggacagggcatgacagggcgggtcatcgagtaggaacattgggaccttttgcttccaggcttgagcagtgggtgagaaacactgtcttcccattagggcagtgggtgaaacactgacttccctccatcctctgggcagccttgtcaggtgggtgtggaagctgaggtgtgtctgccccaggctgtgcagtcagccccgtgttctagcttcccgtgccgaacctggccctggaggctgtctgcctggcaagggggctgcacaaagctcggaggggcatttctggtgcttggtagatggtaggcctgcccccagtgcactgataagagcatgggctgagagtgccacttggattcggctacagtgggcggcagagtgggggtgactggtgttgcttttactctagagcagaggaggcagatgaggtagatcggggccccagggatgctgagctgagctgggtagagagaatttggttttgtaggatttggagacagagacaaatttggagtgtttggatgttcggggacctgcaggaggtatgtgaggtgtgtaaaatgcagcccctgttttataaagagcttacattgtctcttgagaagataaggtgtgcccagctgtggaatggaaccagatgcttttatgagtgaggatggagtgagcacactgggaaagagccctggaattggaggaagagatcattttgcccagagggatcttggaggtctcctggaggagggtacttagatgatcagaaggattatactagacttgatggggtggtcttggcatcagaactttaaaaatgtattttggggctggaagcaaggctggagaggaaggtttgtttaagttgtagtgggggatgaggctgggggcaaatcagggatggttttccaggtctgtaaaggctggggtaagaggaatggttggttcttaagagcaaaaaaaatcccttacatattggttctcttatttgtgctaagttaaatacatgggaggctactggtgtttatgaaataaccctgagcctttttggggaggtagtagtggatgtctgatggaagagatagaagactggtcccaggggttcttagtggcaccttcctctcaggtcatcactgtgcttttgcacattgcagttatatttgactacatttgattatggcagatttacttagaagggcactggaaaaaagcctcccaaattacaactgacacaggaaatgactttattttcttctattttttttctttgcttttctcccccaatcaacatacatttttaaacctgtcatctcacatgacctgccggtagaattgatatgtttaatttctgtagaaaataactggaaatatttcacaagctccagtagcttcctgttgtagggacccttaggactttggaatgagaagttttctattgagttgtcatatttggaaggataaaggtgccctcttttccctcgatccacatagtagactcctgtgtgcgggcatttgtttggtgtctcacgttgatgcaaatgcagccattgcagagtgagccccgctctgttactggatctccatttgctcaaaagagagcagtgtccccctccaaatctgcatgtctgaaagcattcatgcaggttcattgcatgggtctttgcattttacttagacttagcaaaaatcaggtatagtctttcctgaaaacaaaagtgaccattgtttttaatcaactgcagggtgtttggagttgtgaaatatttagggtcccgagtccattccagattcaacattgggaaagaatgagaaagctgaagcctggggcaggctctgtctgcagaaaccatgggctatcaccccctctccttagcagcattgtaaacaaacgtcatttgtaaggagcatgtcccaactgagcttgtaattataggggcaagatttgtgtggtggtaggggcatggagctggagactgggggcttccttattggttcatttatcctggcccttctcttttctctcaagtctcagctcttttaagattcagaaaataatgcaaaatgcctaagatttctgaaattcctggcttcagagacttgactacataaaagagccaggattttcaggctggccatttcaggatcagccatttcccacttcctgattcatagcttccaggatttgtaatgcctgtagacttttttctctcttgcttaaaagtggccattgaaagaaaaaataaatagcaaaatccccatcccagaagttctacttcctgttgttgtactattgagctctgaaaaacagctttgtaagtttaagctcttgtttggactatttcagtggaattcttgagatctttttgtttggacaggcaagtatgaaggcgataagtcgaaagaactacagcttactcagcacagaaatgcagaggctcaaatttaagttcttccttagctttatggtgtgtatattaatataatccaagcaatagtgagttgcttagccagggtgcacagacattttccacaatgccagttgtttccctcataatgtttaatgtttatttttaaaggacatatttgggcacacgtttcatttttgcctgtaaaagaattgggaatatttatgattcttgcaacaaaggagaaggatccaaagtaaccaagaaaatgatggactggcagccttcacattttcccacaactcttttcatgaaataaaatgtagataaggctgggtgccatggctcacgcctgtaatcccagcactttgggaggccgaggcgggcggatcacctgtggtcgggagtttgagaccagcctggcgagcacggcaaaaccccgtctctacgaaaaatacaatacaaaaattagccgcgtgtggtggtgtgcgcctgtagtcccagctactcgggaggctgaggtgggagaatcacttgaacctgggaggcagaggttgcagcgagacaagatggcgccattgcactccagcctgagtgacagagcaagactccatctcaaaaaaaaaaaaaaaaaaaaagtgtaggttagcaaaagtgcctacagttcaaatgcttccatgctaaacgttgtatttcttccggtctcatttgtgatgagagtcataagattttgagaaatacaaaaacctttccagctttataggatgataatggcttggccactcaagtagttctgattgggttaactaattttggtccagtaatcatttcatttggggtgaatggatttttcccccctaaatacgggtacctggaaagttgaagcagtgaatctggtgaaacttaatcagtgatttcgtaagggttaacaaatgtttctgggtgggattcctaatgtccagcttcctctgtgtagctcagtaagtcttctttggagacactagcctgcattgtaagactgtcacatgggagcatctttttattttattttacttttttttaaaaaaatgaggtctttattatcctggctggagtgcagtggtgtgatcatggctcactgtagccttgaactcctgggctcaagtgatcctcttgcctcaacctcccaagtagttgggctgatagacatgagctactgtgccacgtagcattcttggggattattgtagggtccttttggaccacacatggttttatactctgtagctgattgatgtactggcatgtcagtgacattgtgtgtatcattacactatttggttaattgatgtactggtggaatagccatcttctggaggctcttgtttgcatacttctcttagtggcggactagcggttgtacagtaaatagatgatcattctcgctctgttttacctttcctcagctgctcttctagtaggaaaataacagccctcttagctgtagtcttctggaggctctctcaataatagaagtggaaagaaaagactcaaatccctgggcagtgactttttagttgtttcatttgcttttaaggcagaaacacctttaactcttagtagccttacagatcatttttgaaaacacctgtgcttgccttgaatggggcggtgaccactggatccccccatgctgggtacatgttttgcagtcacagacactgctggcctcacctttggtggtgaaggaatgtttccaatttctgctgatggtgtagtgctcttgggagctgggtgctctgaatgagcagatgggcatctgcttttttaagcctgctgttcattctgcaaaatagttattgtgcaaatacctgataagcaccaggtctgtgccaggcgctgtattttgtattttgcatgtctgaggccagcatctttttccctgttcctttttctcctcatccagtgaactttccactgtggttgtagtttgtctgaaaaagatttggaaaaaatgtacagccatgtttctcttgtctagagaagctgtcttaaggacttcgacaagtttcattggcagagtgaatgagtggtggcctctgaatagttgaaatgttaatgctatctataggttctagagaatctgtgtctttaaaagtcatagcgataaagtctcagctttttgagagagtgggtttcagacatactactatacaggaaatctgattgttgcattgaaacaggatttgttatcacatcacggttagacatacccaaaaggcaaaaactacagtggtcatgattgctttacataagattttggaggagaaactgttagctccatgaaagcaggaactgtgttcactcttgaatgcctgctacctgcacatggtgaatgttctataaatgtatattaaagaaatggaggtccttagagttccaagatcaccgtcaatatcatcaccctaggcttcctcgtccttccagttacttcttttccagaagagtccattgcctcctttatatgaggtctacagagcgcgttcagagggctcttatcattgattcagcaatcacgtgtacacatagcactagaatgacttcacatatttgacctgtttaaaaataacgtgcagctatgacgaacagcgaacctttgattagggacacatttgcctgccgccagacactacaagtattatgtgtattgcttttttcaaattataatagtaatagatgattatgagaagaaaattagaaaataagttttctgtctctctataaaaggaaaataaaaattatccttaatctcaaggtaaccattgttaatattttgttgtgttttcctgagattttccccctagacttatatgtgtatctatatatttaaaaaaatgaaattagtagtatactatgtacacacatattgtgaatttctgcccataacattatatctttatcacctggaatgaggtctttaatgaaattattaaaattaaaattattctataaatgctaaatttaggtattttacaatttttttttttttttttttttttttgagacaaagtcttgctctgttgcccaggctggagtggactgcagtggtgcaatctcagctcacttcaacctctgcctcccaggttaaagcaattattctgcctcagcctcccgagtatttgggactacaagtgcatgccaccatgcctggcaaatttttgtatttttagtagaaacggggtttcaccatgttggccaggctggtctcaaactcctgacctcaaatgatctgcccaccttggtctcccagagtgctgggattacaggtgtgagccactgtgcctggcccattttataattttgatcattaaaaaatgatgtgataaaattattgtgtattgttgttgatacactactctgattaattctttgggctagattcctaaaagtggaaagtaaggaataagaattgtgtaagtgtgcatgatcctagataaatattgccaaaatattttgcagaaaattcttagtttcagcttccagaagcagtgtctgtcatccatactccaccagaattgaacactaaattgagctttgcaattttagcatttaaaaagttgtatcatttaatatagaatagcagtctcttcattatgatcttcccttgcctagtaagtttatactcaagtcaaaatcggttaatcatgcatattgattccttgtttatctttttcttttaattctttaatacttctagaatgtatttgtagttaagtgaagtaagatacctcctcctgttgacgatttagtttccccacattgtgctgttttttttcttcactggattatgtaacaatatcttttcttttttttctttctttctttttttttttttttttttgagagagtctcgctctgttgctcaggctggagtgcagaggtgtgatctctgttcaaagcagcctccccctccccagtccaagtgattctactgcctcagcctcttaagtagctgggattacaggcgtgcgccaccacgcctggctatttttttattgtatttttagtagagatggggtttccacatgttggcctggctggtgttgaactcccggcctcaggtgatccgcccacctcaccttcccaaagtgttgggattacagacgtgagccactgcgcccagcctagagactctattttattagtgttttttgtagacaaagtctcactctgttgcccaagctggagtgcagtggcgccatctcggctccctgcaacctccacctcccgggttcaagcaattctgcctcaacctctcgagtagctgggactacaggcatgtgccaccatgcccggctaatttttgtatttttagtagaaatggggtttcactatgttggccaggctggtcttgaaatcctgactttgcgatccgcctgcctcgacctcccaaagtgctaggattacaggcgtgagccaccgctcctggccgagactctattttaaagctgtcttctcccactgatttgccttttgtttgtggtaaaatcattttgtcttaaacactgtagcttcattatacatgttaacatctgctaggaagaatctccactcaggttaaaaaaaaaaaaatttgaagcaccattatttcaggtgaactttgtgtgtgtgtatgttgttttgtttttgcaattcttctccgctactcttccaaaaaagaaaacacaaatttattaggttttgattgttaataaatcagtttgggagaaaacatttccagatatttgaattactcattcaaggacatttcgtgtttctccatttactcaactattatctatctatgaagaaatcacagaaggtcatagaggttgtatacttttccttttgggttatttctggttaatgaatgctttttgttgctaatgtagaaggaatctttattccccattgtttattttatatttttaaattttttttcaattaaaaaaaatttttttttcattcctgagacagggtctcgctccgttacccaggctggagtgcagtggtgcggtcatgactcactgcagccttcagctcctaggctcaagtaatcctccacctcagcctcctgagtagctgggactactggtatgcgccaccatgcctggctaagttttttctttttcttttagaggcaggatcttgctgtgttgcccaggctggtctcaaactcatgacctcaagtgatcctcccaccttcacctcccaaagtgctggcattgcaggcgtgagccaccatgcctgaccttccttgtttcttttaggtgattattggttgtgtgtgaggaaagctctggtattttctgtacttatcttgtacctacccaatttgttgattgctcttattcgttataatagtctttcagttgactcttcctaatttttttgtgccgagaatcattgatgacaaataaggataatttggtctccatttttctggtacataatacgtctttacttaccatcagttgtgtgtcacttaggaatataaatggctgaaaataactgaaagcctgcctaataagggagtaggccgacaggggctgacttttctcaagttcaggcagtctggagggaaggagtctgtggctgctgtgaggtgctcaaagagggtgtgaggactgggctcctggcttctgtttgttcatccttagcctgtggcttttgtcctcgtgaacacaagatgacctccaggaattatgtctgtttcaggcaggaagaagttgagaaggaatgaagacaaaaggcaaaaaaggcagaatgacaggtcagcaagcgctgctcagccagtaggccctgcttctccttggccagaactgagttgcatgcagctggctagaaggtgggagatgaatgtgggtatggctagtgggttgggcatgggggttgggccaaccaagcatggttggtcatagggtcttgctgcattagcctgcacatccagaattgttacatgttgattacaggcatatttgtccttttttgtctatattaatgataatgcctctgtttctcaatgtgtaaggcatcttttggtttaagaggttttcatcatgttgaagaattgcctgtcttgttttcttgggtgatttattaaggatgggtgttgaatgtcatcagatgtcattttggcattcatttggattcagaagtggttgttacacctattaattgaggtaggaatagattacctagtagtaatccctcctcaaattcccgtgttaaactatttttggttgcggtgggtggctgtttaaattcctaattaaatttggtttgctaacatattcagattttttaatctcttattttaaatgagatagctttacagttctctttagatgagttcttttccagattttgctgtcaggcctagactagttttgtaaaatgaattaatgacttttcctttttaccttctctgtaacagtttttatagtgtggcaataaactgtcctttgaaggtttggaacaactcacttgttaaatgcctggaggctgacacttaaaaaaaaaaaaaagaatagtttttgttgtgtttctttttgttgttggtgttgtttttagtcttcagtgcagtggcataatcttggcccacttcagccttgacctcccaggctcaagcagtcctcccacctcagcctccctggtagccgggaccacaggtgttttgccgccacacccggctaattttttattttttttgtagtttttgtagagatggggttttgccacgttgcgcaggctggtctagcattactgggctcaagtggtccacctgccttcgcctcccaaggtggtgggattaacaggtgtgagccaccatgcctggcgtaaaaagatggttagtttttgttttgtgacagctttaaaaaaggtcttccatgggtgttggtctgttccagggttctggttctttcctctgatgctcttttttttttttttttgaaacaggatctcgctcttgtcccagatggtgtacagtggtgtggtcatggctcactgtagccccagcccactgggctccagcaagcctcccacctcagcctctggagtagctgggacccatacctggctaatttttaaatgttttttagagacagagtctcgctatgttcccatgctggttttgaactcctgggatcaagcgaccctcctcccttggcctcccaaagtgttgggattacaggcatgagccaccatgctggccttctggttctttttaaatcaattttagtaatttagtaatttccagcaagtcaattaaaaattatagctcagttgtatgtagtattttctgtgtggtgttatgccctctgtatctgttttctcagatgttttagttgcttttctctcttaatcttgattagacctgccagagctgtgcttattttgtgtccccatccaaatccagaattaattgccgtgctccacatgttttggtcaatggtggacctcatctgtaacagtagtcccatgagattataatggggctgaaaacagtgctgtcccctagggatatcgtgtctgttgtagtgcaaggcactgctcacgtgtttgtgttgatgctggtgtaagcccactgtgcttccagtcagatgaaagtgcagcgcatacaattgtgtgcggtacctaatacttgataataaacaaccatgttactggtgtatgtatttactatgctgtacttttaattgttagagtgtactccttatacttattaaacacaaaattaattgtaaaatagcctcaggcaggtccttcaggaggtatccagaagaaggcattgtgatcataggagctgatggctccgcctgggttactgcccctgtagacttccagtgggacaggatatggaggtggaagacagtgacatggatgatccggaccctttgtaggtctaggctaacgtgtgtgtttgtgtcttagcttttaacaaaaaagtttaaaaagttaaaaaaaaaagttaaaaatagaaaaaagcttatagaataagaatataaagaaaatatatacaagaaccaaaatttaagaaaaataaagtttgtaaaagtaaaaaaagttgtgcttaagctaagtttaatttattattgaagaaagaaatttttaaataaatttagtgaggcctaggtatacagtatttataaagtctacagtagtgtacagtaatgtcctcagccttcacattcactcaccactcactgactcacccgagggagcaacttccagtcctgcaagctttattcgtggtggtactcccatatacgtatgtatacttttttttttttttgagacagagtctcgctctgtcgcccaggctggagtgcagtggtgcagtctcggctcactgcaacctccacctcccaagttcacgccattctcctgcctcagcctcccgagtagctgggactacaggcgcctgccaccacgcctggctaattttttgtatttttagtggagacagcgttgcaccgtgttagccaggatggtctcaatctcctgacctcgtgatccacccacctcggcctcccaaagtgctgggattacaggcgtgagccaccgcgcctggccttttgtttcgtttttaagagacagggtctagctctgtcacccaagctggagtgcagtggcgtgattatagctcattgcagccttgaactcctgggctcaactgattctgttgtgtcaccctccccaagtagctagaactacaggctcatgccaccacacttggctaatttttgttttttaattttttgtagaaatggaatctcactatgttgcctaggctggtcttgaactcttggtgtcaagcaagtgcttggcctctgaagtgctgagattataggtgtgagcctggccatatgtactttttttttttttttttatccttcttactatatttttattgtaccttttctatgtttaggtatgtttaaatacacacatacttaccatggtgttacaactgcctgcagtattcagtgcagtaatgcactacaggtttgcaggttggtagcctaggagtaataggctatactgtatagcctaggtgtgtagtaggctataccattgaggtgtaagtatactctgatcacacaatgatgaaatcacctaactgtgcatttcttagaatgcatccctgtcattaagtgatacgtaactctgcttctttaagcctctgtagcactttggttatgttaggattctgtgtctttacaagtctgctttgctgatcgattgtgacatcttgagggcggctgcactactttctgcctgcaccttgtttcgcatgtctacctggcgcatgacatacacctcgttgttcagttcttgcttctctgcttgtgtctttgcattcaccaccagctattctgatagttatcaggaggttttcattgattgcagtctcgtgcaatgggtgcaggtaatgggtagccttatggaggagaaaatgcttacctatttgggttcattccaaggagtagttcaaggataaacctctaagtttggggagtgctgtaatttgctggatatgtgagccatagaagacagcttggatggcatctgatgcttcctggctgcagggatggaggcagcagaccctcctgcctggggtggttggttgccatccctgtcgggggctcatgctccaccctcaaggctattcttgggggagttgtgacatggctttcataaaaactcagtggaattttaccctgtgtattagttagtaaaggtgagtctggttcagttggtttgagtcaaaaaatctgttaatatctctgctttagacctgcatcaggctaatacttgaatttagggtctgtccctggtgtcatctgaatttttgtttgctatgtgtgaccaaggagatggtcactcttcaggatgggtgggtggaggggagaaatgctatgatttctgttgggtcatgtgaaatcaatttggaatgtggatggggcccttacactttttcttttgagcttagtgattttctgtgtagggtggagagcgattaggaaggaattcaccacccttaggtcctcaggcatagggtcttctaggggcaggactgatgagtgaacagcagggtggatggagcagaaccgttggaaccttcagggcaggacctgccaccattatttggtcacaggaagtgttcagtggtgaacttgttggaaatgattttgagtaacttccgtctcctaaatcatattaggactctttggtctcctatggttatctgagttgttttccaggaggagctgggaaggtaccaggagaaagatgactgtccctctcatgtttgctgagggtgttcctgtaaggtgagctagtgttccttttagggcccgtggagaccgaccttcacattgaagaagcatatctgtgctccgagatgttttcatggggagaagtgtcaggtgtaattataaaaggagtctttctctttaaatactgtaggcgatttagaaatagtggaggtttaattgaagagcttgtctacgtttttacattttccttaggcacagagaaactagtatctttctctgggttgcctttttttttggagacagaatcttactctgtcatccaggctggagtgcagtggcctgatctcggctcactgcagcctctgccttccgagttccagcaattctcctgcctcagccttccaggtagctgggattacaggcacgtgccaccatgcctggctaatttttatatttttagtagagatggggtttcaccatgttggccaggctggtctggaactcctgattaggtgatccacccgcctctgcctcccaaagtgctaggattacaggcatgagccaccacacctggcctgggttgctttttaaattcatacctactgtcttatttgggtctcaaatgtgatcagtggttatacttttcttgctatgcatttaagttggagcaggctccggggcaccacttccctccctagagttgatgaacccctcatatcagtgacctccccatgtcacagtgtatctcgtgtgcactgctagatattctgatcacacagtgctgagattactggtttctctccctttctctttctgtggttatagggattctttaagggcaggcaacatgttctttgtttccataggatctgacaaagtgcatggcataggtaggtgttcatcaaaaggggtggaatagggttgatctcaagggttttaagagagatctgacgagtttgggtgtgtgacttaaaaagcagatacagcgccttttcacggatacacctccgtgattcctcaagtggtctggctgtgtttattttaggattctaaaagtaaagtgttctgttctgagtctttcacgatctgatgttctccagttctgtgaggtctcctcctttagtcccatcattggggctgtttctgctcggaaggccaggaagttgctggaagtctgctgggctttgcaaagggacttttgcttgtgtgggcattgcccagttgtgttacaacttgtttacagccgttggtttttaagggatgaggtaatcttagctcagcttagtgtaatacacaacagttttgtttattgagaaaatcattgttgaagtttttcagatgttagagatgttatgaattgcaatcaagtcggtatcctcttatataagtgcatctgacaagcccatttcacaactacatctcatcagtcacagttggatggcaaggtttattgtttaaagtttttgttttttcttttttaagttgggaaaggaagacagatggtttcagaagccaagaaagggcacaaaggcgtggatatttggaaatcgggacataattcaccattcttcttaattttttctgatctctaagacactgagacagctgttaattgaattgcttgttcacagtatttgagacgtaatgaaatgtgagtgtcctaatcacctggcgggcgtagatctttgggatcctcctggaggcttagtagggctgccctgagcagtattgtcttctccagctgggcctctgagctgtaccatgtgcccgtgctcagcctcagtccctccctcagccagttgttaaatcactttggacgtgtgacagcctcaacatgtcacagctttaaaagttcagattttaaaaaggtaaggaaatgatctcctagtgagacaacttctgcctaaaaaataaaagcttctaagacataaattctgtgttatgaacaacttgcaattttcatagttttcagttttagctctggcagcctctgatagatcttaaatatgtttatcacagctggaaaaatgttttattgtcatctttgtttatcataatatgccacctactctggttgtgtcttacaactgtagctctgtggggttttttttgtttgttttatgcttgctaatgggggaggtggggggtgggggcggatgaatataaatgatacctagaaattgaaattggaaaaaaaaatgtattcagccagtactctttccaggttatagctaaacgtcagttggcaacctctatgctgtggtttattgagtaacacttaatacttagcacagccctcagtgaagatcttttatggccttttctgaatgttatacaaacataactaaagcttatccagatgaggacagggacctttctttccttcctttttaaatggagcaaaatttggccactgggttgctgtggatgagagagtagaaggagaaaggcagtcatcgggagactgtgtgctgagagagcgcatgtgggatttggcttcaggaagtctgggcttgcattctatccagcgctaatatttagtgagtgtgatttggggcaaattatttcgtctccctgagcttcagaatgtttgaaactttgtgaggagtctgaccccacactgtaggctccctccatgtatatatttcttcttccttttcctttttttttttttttttttttaaatttttgagatagtgtctcgctctgtaaccccagttggaatgcagtggcatggtcatggcttactgcagcctcaacgtcccaggctcaagggatcctcctgcctcagcctcctgagtagctggggtcacagatgtgtgccatcacgcctggctaatttttaacattttttgtagagatgggagtctcactatgttgcccaggctgcactcaaactcctggactcaagcagtcctctccctccagcctcccaaagttctgggattacaggcatgagccaccatgcccggctggaactgttggctttgaagaagaatgatgctgtgcttgcctttgcagtcctgtcaccatacttcctggaaagtgggtggacacgctggatggtagatgttgagttctttagatgcctggatgcttacatgctttgtgtgggttcttactggggctgtaacttactagaggacagactccaacttctgcttacttagtctggggaggttaataataatctagggcacccgcttcccagtgggtttccatcagtctcctccagcccactctactctctgttagccagctgggcacctcttcctctgtgtcccttcggtatcttcccagtggctctttccacgactggctcagaccatgtgtatatctgctcattgtctgtccagggtccctccaaagatgcctctgtgggctgggcccctggtggtgcttcctccagataattgttgaagatggaacaggagtgtgcaagaacaccagcgtgcttccagtattcaggtctagcggcaggtcccaggcatcagcggctcaccactccaccgcaggtagcctgattgcccagccttggagccgcagcctccttgggtggtgtggcagctgtcagtgtctgaaaccattttgaactttaaagggtggtgtcagacagcagctattgaggctacttaaaagaatttttttaaatgtacgagttcagtggcattaagtacattcatattgttgtgcaaccatcaccactgtccatctccagaacttgttcatcttcccaaactgaaactccatgtccatcaaacaactccccattgcctttttccccaagtctttggcaaccgccattccactttctgtctgtaaatttgactgtctggatacctcatgtaagtggactcgtacactatttgtccttttgtgactggcccattttatgagcataatgtcctcaaggttcattcaggctgtagcatgtgtccagaatctccttcctttttaaggcccaataatatttaataatatatgtatgtgtgataacacatttatataatgtccattaccatgtggtatatatgcttatccatttgtctgtcgatggacacttgagttgctcccccgctttggctactgtgaataatatgactgtgatcatggatatgcaaatatttccttaagtctttcagttcttttgggtatatacccagaagtggaattgctggatcatatggcagttctatttttaattttttgaggaaccactgtactgttttccatgtagactgcataagaattccaatttttccacatcttgccaacgtttatttttatttatttctttaaattttttatagtagctatccattctaatggatgtgaggtggtatctcattatggttttgatgggacttttgagttttagcaaatatcaatgaagtatttaattttttttttttttcttagagacaggatctcacattgttgtccaggctagagtgcagtgatgtgagcatagttcactgcagcctcaacctcctaggctcatgtgatgctcccacctacgcttcctcaatagatgggactatgttcctgcgccatcactcctggtgaatttttaaatttttgtagagatgcggtcttggtacattttctaggctggtctggaagtcctggcctcaagcagttcttccacctgaacctcccaaagtgctgggattataggcgtgagccactgcacctggcttatttaaatttttatgggtatgaattcacttaaaagctgaaggttttgagaggagagggagcatatgaaaaaacctaaaggttttgggaggaggaggagaaggaagagagggagcatgtgaacaagagcaactgattacttccttgtcattcatttgcccagtgtttactaagcacctgctgtgtctcagacctgtgctggtttggcccttgtgaaggacagtaaatacagtgcagttccagctgcgcatgggatcacagtccagtaggtaaacgagtgcctaaacttaagagaaatgagtgcagttggggtcctgtggcggtgaaggggcgagtctgcacccaggcgagtgttaaaggcctggcctagagaagatgggtgttttgatggaaggagctgctgggaagcatgtgtactcggtgtcttggagtttagaaacctcagttggctccatgtctcgtccttagtaaaggaatatcgggagctgagactggatgtattgacacaggtcaaatcacagagtcttaggccatttcaaggaggttggatttttctctggaaggcacagggaggttttgaaggacttaatgcagaagaatgggcactgtcaggtttgtggtttggaaagtccgccttggtagtagggtggagggtgcattatggagggctagaccagggtccagcccccagcgagatgctgtgtggtaaccaggggagagagaggtggtggtgttagaagccacgacttggcatagaagccaaagcatccccaggttgtcattgtgtaattaatggttaagttggggcaagaaataaagctcttaaaagtgtccagctgtagagctctctgcctgtttttatcttcagatttttgtctttgccatctctggcctccagtggaaggccgaagttacttaacttccttgctggaagcagggctcctcatgattgccagcccctgtttggtagtggtcctggagtgctgtggaaatgggatacttggtgccacttaccttggggctttgctcctgaactgcagcggtgtcttgtgctctgtggtttgtagcatggaacagaggctgatgggcggggagtttgagtcccagtgattgaggccccctgcctgcctgcaccttactgaaggaaggacatggtggcttctcagtgtgctctctggtgatctgaacctagattcttgtttcacgggtagggggcagggttttggattcagccctggccagccctggcccaagttcatagtgtcagtagtatagttctcccaccacccccttctctcctgctcctgttttctcccccgccccttctctcctactctccttcctctcccactctccctcctctctctgcctttcacttccccccacactctctctcccccgctcccaactttctttctctcttcgactcaccacacaacacacacctgtgtgtgtgtgtgtgtgtgtgtgtgtgtgtgtgtgtgatggcactgttatttcatgtgtatacctttgcgtagcgttggcacatgtgggaatgctattataatgctttcgttgggggtctgtgctaaccactgctgagtgtgcttcatgttttctagacagcatgagaccagagctctccaccttgccattagctggtgggagaattttgagaaagtcacccaattgctcttaagtcctcatttttttttttaaatctgtaaaatggtatcacagatgcttatagctcaagactagttgatgagggtctgtgactcaaaaggccccatagatggggttcagagggcctttggaaatggcgtgcaagctctttgtaagtgtattttttttggagaaagggcccagctttttatcagacatcctgagagattcaggacctaaaaaataaaccttgattaatcttggaagcctctttttacgcagtacgctttgattcatcagtatatgcatgtggatgggttctcagatggcctgatgtttctcctccttcctctgtgtggtgggcgacgactttggctgcccagatgttaacatcagtaagcagaagctcagtcagtgttagcaaaattaaatcactctgcaaaaatcaatgttagtgaaattaaatcacttgatcttaaaagcagcatgaaatagcagtttttcatcttcattgtgctgttttcccactctagatatcttgcagattttttttggttgcttggttggttggtttttggcgtccttttcaaggacaagcagctttggacagttgcactacttttttttttttttttttttttttgacagagtcttgctctgtcacccaggctggggtgcagtggcgtgatctcagctcactgcaacctctgcctcccaggttcaagcagttctcctgcctcagcctcccaagtagctgggattacaggtgtctgccaccacactcggctaatttttatatttttagtagggacaaagtttcatcatgttattcaaattcctgacctcaagccatctgcctgccttggcctcccaaagtgctgggattacaggcgtgagtcactgtgctcagccagttgcactacattttttttttagatgccattgttgaggatccaggggtttgtcatagattgattaatcagaaagtattaatctaaagtattagaatatattgattgcaggcagggaccttgcatagtttaaagatgactcagaaggcacattaggttcttgccacactttgctgccatcacagatggatgtgagttgcccccttatataggtctctcgggatgccccagtggagaacagcattgatgttgaacagatcctgtccgatggagagataccagcgtttcagccagcggtgtgagtgagggcaggggccacctctgagggtgcttgctccctcacactgtcctcacgctgccctcaagctgtgggcaaaggagagggatcctgtgccatcacagccctagaagcagaattccaaaatgtgggctcctttgggtgtggtttgggggtcaaggagatagagcaagtaaggaatgaactttgagggtttatgatcattttcatgatgataatgacctaaaaacatgcttggctgggcatggtggctcatgcctataattccagcactttgggagactaagacaggaggatttcttgagtccaggagttcaagaccagcctggacaacatagggacaccccatctctacaaaaaaattaaaaaattagccaagcatggtggtgtgcacctgtagtcccagctactcaggaggctgaggcaggaggatcccttgagcctaagaggtcaaggctgcagtgagccatgtctgtgccactgtactccaacttgggtgacagagcaagactatcccaaaacaaaaacaaaaacacatgcttatggtaggcaattaaaacaggaggtaaggagtaaacatgccaggcccctcctcctctcctctgactcttccttcttcccccctgcttcccaagggtaagctttgcagatacttgctatgcaagcaaaaatgctattcttagccatcgtttaaacacagatttgcaatttgtggtttttcatttatataaattttggctctcttcctatagcagaatgatctttgtttttaaaatgattttaagtatacaattaatatgtgaatgtatgtttcttatggaaattagaacaatacacagttacagagtagaaggtgataggtgatatagctcaccctctcctcttcctgctactctccccagtctgcttcactccccggaaggaactactggcccatcagcatgtctccttccaggcattttttccatgtggttatgtccacctgcataagaaactgggggcggcagggtggggcggtgttggcgggtcaggcagaagcaagccacagagcagtaagggtactttttaaaaaaacatttaaatagatccctgttgtcctgcggcttacatgctcatgcatactcactgtttctttaaataaactttttcttttagaatagttttagatttacagaaaagttgccgcgatagtctagagagatcccatgtacctcttaacagcttcgcctctgttaacattctgtgtcaccatggtaatttgccacagctaaggaaccagcattagtccatgactgtcagtgaactaaactcaagactttttttggattttaccagttttgcccaatgttcctttcctggtctaggatcctgtgcagaatagcgcatcacagcacattacatttagctgtctccttcacctcttctggtctgtgacagggtctcagactttccttgtccttggtgactttgacagtttcgagggacactggccaggttttgtgcacactgccccttaatttggagttgtctcatggttttttttgtttttttttttttttgagacagagtctcactcgtctcccaagctggagtgcaatggtgcaacctcgactcactgcaacttctgcctcccaggttcaagcaattctcctgcttcagcctcccgagtagctgggattacaggtgcctgccaccacacccaactaatttttgtatttttagtaaagatggggtttcaccaggttgggcaggctggtctcgaactcctgacctcgggtgattgcccacctcggcctcccaaagtgctaagattacaggtgtgagccaccctgcccggcccatggttttcttatgggtagtctgggaccatgggtttttgggagcaagaccacagagctgaaatgccctcccttcagtgatttgtcagcatgacctatcaccattgttgttaaccttcaccacctggatgaggcagtgtatgcgtggggacatacatctatttgccccactgacatgagggttggatctctagaagaggagtcactgttcagaggttataggcatttgtattttttggcagatgttgtccttcaaaatggctgtacacatatgctcctcccaaaagtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagatcacttgagctcaggagttcaagatcagcctgggcaacatggtgaaaccccatctctaccaaaaatacaaaaaaattagctgggcatggtggtgcttgcttttggtcccagctacttgggaggctgatgtgggagtatcacttgagcccaggaagttgaggctacagtgagccgagatcgtgccactgccctctagcctgggtgacagtgtgagaccctggctccaaagaaaaaaagaagattgattgagatagggtcttgctctgttcaggctggaatgcagtggtgtcatcatcatagtttactgtagccttgaactcttgggctcaagcagtcctgctcctttggcctcccaaagtgctggggttacaggcatgagccactatgctcagccaagctaaaaatatcttagtgtgcatttctctaattgtcagaagtgtatttatttaccataccctggaaaccttatgtaagatgatggtgagtttggactttccagtaacatttggaaactgtttagtaccaagctctcattaacaatataaacaaaataggggtctacccttaaggaatcaaagccattatctaaaagctctttcccgcaacaactacctgagataatgtccttggtcatatgccccagcatttaaaaatggagttagtgagagtctgttgtttaccacctgatacattggtaagagctgcttgatggtatggggacatcagtagggaggatatagacgtagccacccccgccctagatagtaggggcctcagggtggggtaagcctgggtgggggaggtatgagtggtggaacagtgggagaccctggatccttagtctccagcgtgattgcattttgccaaggctttgtcccatgtccctttgtcccgtgttccatttgcccgtggtgttgcctagagagcatggaggggctggtggagcatgctctgtggttccctaacccagggctgtgtggggagagcttgcagcacccccctgaccccatatgaacgtccttgctatttcctgctgtgccatccagcaactataggatgctgtgctgtggctgggagacctgtttggtcttggaagctgggtcctggatgagcagaatgaggcaggcatagaggtgatgttggctacgggcaggggagcatttgctttgccttggagtagtgccatttccatgtagaggggcaagatttaccaccctgttgtggggatttgagactttgggttttgttttcctttacaccttgagctttgttctacagcaggtccctgggaagactggtccacaaagctgctgaatggggctgctgtccttcagccctgcctcctgctgcagaatgcagaggacgctgtagacttgcttggtgggtgcctggggttttctgcctccctggtgcactgggcacagcggcttgcctgccttttgggtcgtctccacctcccagggatgtttttgttccctgatcgaatgacctcctgttttgtttgttttttgagacggagttttgctttgtcacccaggctggagtgcaatggcatgatctcggctaactgcaacctctgcctcccgggttcaagtgattcttgtgcttcagccttctgagtagctgggacttcaggtgtatgccaccatgccacgctcatttttgtatttttagtagagatggggttttaccatgttggtcaggctggtctcgaactcctggcctcaagcagtgcgcctgcctcagcctcccaaagtgctgggattacaggcgtgagccaccgtgcctggcctgacctcctgtcttctgtttttgcccactgtcaagggtagacttcttcaaggctgtacttgtgctatcctaaagaggagtaatgggagacatttctgactttgtcagcatgctgcttggcagcacctgcctcgtttctggtgaccatttggaaatgtgtcctttatctggtagcaaggagcatttacattgatccctatgcacttaattggcatacttttattcctctggattttttttttaaagcataattgttcgtgtctacatgatgtaacatgctgctgacttttaagcaaattaacagagttcgtgctgaagcgcaagggtgcagggaaacaaaatgggagggttattaaaggggtgaggcggctcctcaaagatgtcactgcaccattcattcttgtgttcctggcccatggcaggctcattaatcctccacgacaatccattagcatgcctgtcaacccttcagagaagatgagccataggaaggcttagggatccccacttgaactgctgtgtggctctatgaacatccccaccttcctggagtgaggtggttgtggccacctgactttccccattttttttttttggacctcagcctccagcgctcctgggccagactcagggtgggggggatgcaggtgccagtgactgacacttggcccctcacacttcactgcctgatttgctttaaaggcaagggttgctcatgcttgtctgagctctccatctgtttgagaattatattgttctcaactggaacttgtaaaagagaaaaaaatgtacttctcaatttccatggaagaatatagattttctggtggggtggaaactttcttagcatgaagggatctttgtgtgatctgcgcatcagcactgaataaagaatgggtgcgccgaagtcggggaggccgactttcctgtggcttgctggggaaagtttgaactgtgtgtaagcagtgcgtggaaggaaagctaagtgtggagataacgaagggaatgggatttaatagaaacagggtgtgatgagtggcagttgcctgatgaagtggaaatcttgtgttccaaatttgtgagatccatttctgtcctctaaggaaaatgttgtatgtgcaggaggagttcatgtagttgggttagattgtgttttctgtctttattttttttcctgcctctatgggttgtgaacaaaaacaagaatttgatattctgcagtatagttaactcgtgcaaacagtgtatgcttttcagtgggatataaggtctgaaataataggattttccctagtaagtcagtttcattcctttacatgtgggttatgagatacaaagtgaagctctgtaaagctttttacgagctccctgtgttgccctcctttgacgggtcaaggcattggggttgacagaggtttctactctcagaggctttaaagaggtgcccactctggtgagatggctgtcagcatgcacgatgtgtgtgagagagcacctcttcaatcatatgcacctggctgtagcatccttgtcagccttaagagatacctccaaagcggaattttctacccctagaatcatgtgaggtcatctcaatttaagccccagctctgctccctaaattacctgagtgatcccaggtaggtcatttgctcattgttaaccatcagtttccttagctgcaaaacagagcagataacaccccaaaagagttctcatagtaaatcacatcaggcttacacaatctcagaaatgtgcagctccacaggaatcttcattacctctttaggcagtccagtcgggtttcaaatgaatcctactgtctgttcttatatggaaccacagtccctcaccctgtgttgatctaagttctctgtttctctcctccagcagggtcataaagagcctgaccagtccccctccctggagacctttgtgtgctgggtttctgcagccgttctccatgagaagggacttctggtccctgctctcacttggatgttcttccactgacttatctctcttaatgtgtggaggcagaaacccagttttcagggtctctcccctggccccttactaagtctcccttaggtacagtctaagactgcctgactttttcttctttttttttttttttttggcagccacaacatcacatcgtcacatacagaaattatatccaattaaatctcctaagtctttttcacacctcctacatttgtgcatttctttttttgcacccaagtgtccaaatagcatttatttcctctctattgcaattccaatctgttgatctttttagctcttgactctgtcatccagtgtatttgccattgctcctggaaacttgtcatctttgaattagataaacattttatctgtgccatcgttcaagtaattgataaaaatgttgaaatctacagtactcagaaagagacctgtggcctcccactagagaccttccttggtctgttcattaatcagcactttgtagggtaaattgaacatttactaagctattcagatgtagttcatatttcttcaccttgtcaacaaagagatcttagcaaggcattgtagaccaagtatgtgttcctggaatatacatattaagaaaaaatccttatgccaagaaaatgggcacatccccaaaacccaggttattgtagtttacggcttctgacccagggcttcactttgtagcagtgtttttcttctgtttttgcctttggctgataccactgctagagtgcagataagagaatgttactaccagggggcttgagtgtcgggctatgattggctgtcatctggagcagagtgggactgagctgctcaggagaaaggtcttcaggtgattttttttgggaagctaagagcactggttttagacatcctctcctggctgatgatgggattggccttcatggggctgctgtctggctgggctggtgggcagaggttcctgtgggtgtggatggagaaatcctaaatgccgagggtacctggtcttagtagaaatcgtaggatgcctcagtgaagaagtcagggatgcggattgtcctccggatgcttggatgagcgtgcagtggaaaaagtactcctttgggggaagaggtgaatctggaggtgttagagcagaagagtaaatgcagaagttgtagcagatacaaaggctttggcaagagtgggagtgatcattgaagggaaggcaggggcttgctgggacaggctggagccgtgatggaccctcatagtaaccctgctgcattttacaaaggaagaactgtgttggggtacagatgtgccaaacactcaaagttagaaaatcaacgcagtcggttgtggcttctgcccttgaaacatcagatagtgagaacctgccactgttcagtttgcagagtggttggttgcatacagtgttttagctcttgcccactcaatacagaggttgcatgcgggcgtccacctgctccgccacctctgcctgcttgtggctgtgtgcccagagcccatttccctggggagtcagtgcagcactcctgggggacccttctgtttgtgtcctgacgaatctgactgtgctggatgcagtcccacagccacacctggtatgggtggcatctttaaaggcctggcctgtgtgtgctgtatctgcagcagagctgtggccaaacctgctttccttccatctgggttccccttggttctcggtggtggacgggctgtgtggtctcccctcagctgtccacttgcacttgtgttaaaatgcggcagaactttccctctatacttaaattgtggtgaaatacgtatgacataaaacttaccatcttaacttttttttattgagacaggttctcattctgtcacccaggctggagtttttttattgagacaggatctcattctgtcacccaggctggagtgcggtggcgcgatctctgctcactgcaacctctgcctcctgggttcaggcgattctcatgcctcagccacccgagtagctggaattacacgcgcccgccaccatgcctggctaacttttgtattgttagagatggggtttcgccatgttggccaggccggtcttgaattcctggcctcaagtgatccccctgcttcggcctcccgaagtgctgagattacaggcgtgagccgccgcgcctggccttccttttttttttttttttaagagatggagtcttgctctgtcgcccaggctggagtgccgtggtgcgatcttggctcactgcaacctctgcctcccaggttgaagtgattcttctgcctcagcctcccgagtacctgggattacaggcgccaggcaccatgcctggctaatttttgtatttttagtggagatggggtttcaccatgttggccaggctggtcttgaactcctgacctcgtgatccgcctgcctcggcctcccaaagtgctgggatcacaggtgtgagccaccacgcccaccggcctcccatcttaacattttaaagtgttcagtttaagtacctttacactgctgtccaatcaatctctagaacacttttcatcttgaaaaacggaaactctgtacccattaataactcccattctctcctaccacagccacgggcagccactttctgctgtctccgtgagtctgactactttgagtacctatgagcagaatccgcaggatttctccttttgtgactgccttatttcacttagcataatgtcctcaagctccatccaggttgttgcatgtgagaggatttccttcctgtgcatgaactagagtgatgcagggactgacctctggccatgtgatgggtggttggtgatggatccaagaggtagctggtctctgaatactagcccagtccttttccttgctaggaaagtccccagatcagatagaaagcctcagtatttcaagaagcttctgttttgacaccacatccatgaagaatcacactgcagggtaggggaacagatgagtgggatttctacactgttatcagctagacttagataactggctaattgaaaagagtacaggtcacttaaggaaactggagcattgtagggcaaggtaaagtgcttttgaaatgaggatgtgaactgtaactggaatgatgtaatgtgttctacaaaatgaagccagtgagaggacaggggacacagggccgacttttatttaggacatttgcctggttctgagaagaaagttgaaagtcacgagagagagggaaaggaaggcagaaggaacttggtttttgcaggtgcctgctcagcatgggccttgccccagcttggctgtacctcacagcaccatccactggctctacagtctgtccttcggaggtttagggtgctgtctcatgcacagtgggtgctaggtggtagtgaggacagggtgtgggactaggcaggtgctgcccctcggaaggcctcatggtgaggcaaagatctctggctccgagggactctatctcctggtgtcctgcttcatcgagaagccagccacccatgggaactgtggataattagaaaggcttagaggctcttctaagggtgttttttgaaatatggagacctagaatattgggctttgggatattttaagatgagaaaggcatttggagtaactgtcagagcagataaagttgtttttatgaagatccgggaaaacggttgttacaaatacagctctgcaccaattctgcgccagtctgtttggctacagatgctttcagtggaggggacactggggcttgtgttccctttagtctttgaattcccgttaaagtttccatgtcttaagtggcgtggcaggatagaaacatctcacccatcttagtaagttctttgctgtatgtagcactctggttttaacgttctgagccttcaggactgcccttgatgtgtgcatttattttgttgatatgcatgatgtgtgggtggctctgcggcagtaaaacagttcacattcaaattacactcggtttctaatttctgttctcagagtttcctctgtaatggaaatctcttacattcttatcattgccttcagttattgaatgtgttaggtggccaggattgctgtctgtgtgaaatgggaatgtatatatacaacgtaaacatgttctgattgacacgtgaagataaagggcttaacatgaattgtgtcggtttacacttacacagaaaattctactgtaataaactgaagtgtcagtagtgtttgttatcataacattgtctttttccctcttttctgatctctgatttttcaattaggaatgaggcctaaagaaacccatgctctctcttctctgagcgcaaggagggtgtgctgagaccttgaagggcacagcatgggaggatcatatactagggagagtctgtctccaccccatttttcttctgctttgctttgtttcgtagtttcttcgggcttcttgggggttttctgagagagagaatgtcaatttgagaagtaacaggtgcacaggctttacctgcaccacactgcagataaggtgggtagggagggtagtgacaggtggtgtggtgggttattcagttctttcctagggcagtgggtctcacagggtggtgcttaggccagcagcatcagcatcacctgggtgcatattagaaacaaattttggggcctcacctcttgcgttttaacagttccttcaagtggtcctgatgcatgttgaggactttgaacactcctcctacaagcaaagtgaagttgacctcccacacacttgtctcagtctgctttctagcatctgtcccattgcctttgttgttctccccgccacacgggctgcacccctgggattcccccagctgccaccaggcatcagctccagctgcctcccagggtgtgctcctgcctctgcttggagtaccctgcctcccactcttcctggcaagaccctgctcatctttcagggtcgtctctgctgagaagtcttcctgacctcctcggagatagggagttgtggggccttgtctttatgttcccagggttctgtctattgcgctattaaaactttttttttcatttaatttgccacttgctagagagatggttgttctgccttcgttgtgcaaaattcagtgatacactaatcctctcctaacctcttaaatcattttgactttcacagagtgatagtgtctagagagggtttttgttgtactaagttattggttccaaagaattcattttaagaggagtaaagaactattatagtatgccgcttactgagacaaaaccgacttctcacataagcccaaaggttttgttatgttggattttaccattagagttaaagatgatgattggttcactaatgtgctttaccttcacagtgtgcctgtagacctgtagtaaaagaaggctaattatgtttcctgatgtcttttatttccaactataagctaagcctatctcattttttttttttttttttttttttttttgagatggagtctcgttctgtcacccaggctggagtgcagtggcgtgatctcagctcactgcaagctccgcctcccgggttcatgccattctcctgcctcagcctcccaagtagctgggactacaggtgcccgccaccacacccggctaattttgtttttgtatttttagtagagatggggtttcaccgtgttagccaggatggtcttgatcttctgacccgtgatcctaccgcctcggcctcccacagtgctggtattacaggcatgagccgccgcacccggccaacctatcccatatttttaaagaagagttgatcaagtagttacccattttaactaaatggataactataacattctttaatggaattgttgacagagggataatcagtgtttttgctaattcatgccaccctcctttgttgtatgttagtaatatttacattggggcaacaaaatagatcagtatttccattaatgtttacttaataacagctgctaaaaggtattactgtttgcagtaacacaaaagcacttacctgattcttatgccagcttctatagggtaggtagtgacagcccattttgcaggtgaggaagatggggtttagaggtgaggtgtgtctgcctgagagcaggagctggtaaatggcactctgggctcatgggagtcacgctgtttttttttttttttttttttcctaggacctcaaggttgtgtctaagacataatttacagttctcgtgtaggtcttccaaatacttagctacacagctttggggcgttttctcagccaaatacttttctttagcccttctcatattaacatttagttcttagggatttattttcaaaatatatatagcttgtatatgccattcacctaagttgttagagcagacattctgcctcttgatctttagaaaatacctaagagtattttgttaacagtactcatttcagctgaaagactttattttaaaatttaatttaattttattattgttttttgagacagaatcttgctctgtgtctcccaggctggagtgcagtggtgtgatcttgacttgttgcaacgtctgccttgtgggttcaagtgattcttgggcctcagccacccaagtagctgggattacaggcgtgcaccaccacgcctggctaatttttgtatttttagtagagatggggtttcaaactcttggcctcaagcgatctacctgccttgggctaccagagtgctgggactgcaggcatgaaccactgtgcctgacttttaaggctttctttaaaatggcatcttttggccaggtgtggtggtaatcccagcacttctggaggctgaggctggaggattgcttgagcccaggaattggagaccaacctgggcaacatagggaaaccctctctctgccaaaaaattaaaaaacaaaacaaaacctaggtgttatggtgtacccctgtggtcccagctgcttgggagctgaggtggaaggattgcttgagcccaggaggtcgaggctgcattgagccacgattgtgctgcagcactctagcctgggtgacagagtgagaccacgtctcaaaaaacaataaaaaataaataaaatgacatctttggagaagtgaattctacccaggtaccaagcccctgcctgcccctcccaactcccttccctgactcccagcacccccatctgttttggttctgctgttgccattctctggctttggggactttgctgaggccccactgtccccatcttccagctgtaccctttctctctgcttccctgcttgtcttattctttacagggctgcctgggatctcacattccaaaagtttttgggtttgtttttggatcatgccaatatcggttgctttgagaagggagaaagggtattttgcattttccttttaatcatcggtgagtagccacaaagggtgtgtctctccctcttgtgctgtgtttactgtttactccctcggtgcatgaattatttcatggcaccagtggagcatattttcttctctttcctgtttgtggcttgcgcctcctgaacgctgctatcattcatggtccagcttggttttctttttcactgtttctatcacaaaacctcctgaagaccagtggtgtcagtcataggctccaaaacagctggttcctaggccctgcctcgtgctctgtggtttgggcttgtcttttcttccagagtaagtgggtagcttcttcctactttttttctcttttcttctataaatgggaggaaaagtgtgaagtatggagactgctctttcatttgaaggaaattcacagttccagctctgtagtgtggcctctgttaactagtggtcaacactgactgtggaaggggggccagatggcaaagtgaagcagattctttcctcctgtctgcattttgattgcagtatgaagttcaacttgcttcagtctttgtcttcatgttgtttcactaggtactgaattttgtgatctgttggaaataacaagtaaatagatgcctaacgctttatacaggttgagcctgtctaatccaaaaatccaaaatccagaatgcttcaaaagtttcagcttttggagcactgacatgacaccacaagtggaaaattccacacctgacctcatgtgacgggtcacttttcgaaactcaggcacacgacacacagttaatttagtgtccccaagggaaaaaaagaccctcccggcccccttcagctgtgatgtgtcttttccacacatgcccagattccctcagacacctccacaaagggtaataaaatggttcgttgtatacaaactttgtttcatgcacaagattattaaaaatatataaaatgactttttagagaagcgagaagagaaatgagaggtaggggagggagggaggagttgggggacagttgggggaatagttgaagctaaggtgtttaggcagagctctgaggaggtgacgtttgagtggagacccagatggctagagaatggggcagcctcctgaaggagcagaagcactgtgggcggcagggtatcacagaggaggagctcggtgtgttggaggttggtgagtcccgtggagtcttgtcagatggtgttgggacagggacggaccgtgaggaggctggatcatggggaatgtgttgctttaggccaagctggagttgatagtggctcagatcagagctaaagtagtggagacacacagacattgaaagaatgatgaaattcactcattctgcgtgtgtcccatgtcatgtgtccgctgcacaccaagtactgttttaggcactggtgatataattgtgaaccaactggagctgcggtgagagagaccatgaaaagaagggccagagcggtgtcctgcagagggtggtgtaccttgggagggaagtgtgtagggttgttgaggaacagtgtgctgcacagggaggaaagacgtggggcagcattgtgggaagagcaaccaagattctcataggcttgggagcggaagccctgaggtctgttgctggactagatatgtgaggtgtgagaggagagaagaatcaggaatgactctttgattcttaacgtgagcaactcagagaatgagagtgctgcagtttacaagcttggaaggtggattatgtggggggatgagtgagttgtttgacacctcaatggatatactcagatggatgtatacgttagagctcaaaagagtctgggccagtgacatgaatttgatcatatctagagtatgagtggcacaggaagccacttgtctggatgaggtgacagaggaaaaggttgaggatagcaaccaacatttagaggtaaggtagaaggcagagcagtgtggaatcagggaagccgagaggaggaggcaatgccaggtgactggaaggtcaagtgacacttcgacagtgtcactgagggctctgctaggagctattcggtgtcataatggggacagaagctcagtcggagtgggttaaaggtaaccaggaggtgagggtgctgagaggtgggactattgacaagccttgtgtcaagttttgctatgtaggggctgaaatctaatgtatgtgactgtgtataagtgacttgacttccccaaatctgtttcctcacctttaaaatgggtgtttgccaagtgctggtttctgctattcttttctctgtcttaggggtgtcattttctctttggtaaaacagaagaattagatgatatgaagtttcacattctaagttctcaagctttgcccactcctcagcccttgggtccctccacttcctcttctcttcgctatctctgctcagtttctgtctttgattgtaatgtaatgcccagtgggacttttcttctctccctcgtctgttcacttattccgtcctgcactgggccaccagattaatcctgcaaaaggcctcacatgggcttctctcctgctcaggagccttgtgggggctttattcctctgagatgaaagttcttatccccacatgtgatcctttatgacttgggtgctatcaaattcatttcctcaactgctcccctcttcaccctgaccatcagatctgctggcacatgggcataccttgttctgcattgtctctggcctgtgggatatttaccgagctttaaatcctaggcaccctttgggagccggcctgtgtgcagagctccccttagcacggtggcacaaagcttggacaccacctcttgtctgtcctgcttaattccattcacatctagagtggactcgctgtgtgcacaccactgaccacctgcctcatgtgacagttgttcctcatgggtcttagctctttgccttcaccatgagcctcctcagagggcagggcactgcctgttggcatttctcgtggtatcatacatgttgggtgcttcccaaattaattacatcagtcagaaaacttcactctatctgagaagctttaatagtgtacttgggattattaaatcctaaaaaaggttatcacaaagagttttcttggtgtgtgtctgtgcttagaatttagaaaataagtcatccagtattgaggccattttatgaaaagcctttaaaatctgcaaatgcgttggcccagcacttccacttctagggatttatcctaagaaaatagtcttgggtatctgccaataatgttcactggagtgttgtttataatgtgcaaaacaggagctaacctaaatgtccaacaataagggattggttaaaaaaaaaaaacaaccctcatggtgtgtattaatactctggaactactgtccccttaaaatggtgatgtagaaggacatgtattgacctagtaaaatattaagtgaaggaagtgtgtttacaaatgtcatttttgtctgatttcacttaccttcatttatagagagtggataattggcatagatagtgttaacattgtttatcgtggaatgttgagatcgttgatgatttttactggtttttttttttttggttattacctctaaactctgtaggaagcatgctttcttgatcaataaaacttaaagttggagtttatgctgcttttattcataaaaaaatcacgtttttaatcttctgttaggttatcctttatgtctacattaatgcacgtgtggagagaacacagtctactcggcttatgtcaaatggtagtgggaagcatggaagcatgcgttttttagtccccactttacaagtcacagtgacggttctccagtgtagagtagattgattgccctgtgtccttcaggcagggtgcagtagtaagttattgatacttggctgctgagctgtcgttcaggccttggcaactgacgctctgcagaacggaccaggagtgtgcggtggtggagtccggctggcctgggttgcagatttaactttcgcctctgcctctgtgtgcctctgggctgtaagctttagtttgcacggttaacggggatggcctctcccatggtcggttggagtgtgttgcacagcgtctggtccagtgttggcactgtataaatgccagctaactggttagccacctaaactgtcagtctgcaacccacagctctgcagtgaacaattgaacctcatttctttaataataatacaggattcctgaaaaccaactgtattattgtttggaaaatagtttaaaaattatttccttctaactgagacgtttaccctcttgtctcccttcagtctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaagtaagaatgatgctgactgctgctttctctctgcctctctctctcctctcctcctccttgacctcccttctcttctgagtgcacgagttccgctgggcagggtgcagtcgtgttgcatttaggacgtggcatgcctgctgtgcggaagtggttcccagtgggggtcttggttggctttcctttgcatctgggactcttggattgcgggactgtggcgtggctggaggccatcatggctgctgtcaagactgttcaaatcacatgttagaaataatccagcacactcctgggctagacacttgctgaccttcagctttgaattcctgatgagaaaggtgacctggtgtgcttggaagtccctgagccttggcagctgggggctgcttatgtgtcagctctttcatcctttgtgcgaagtgatattttttgttctgcaggacttccttagtttgaatggacttggaatatggttaaataaagggaaggtaaagcactaactcatatcctgtgaaagtggtccttaggtcctagtgatgatgttatgatactcaggtgtcctggttatgacagagcacctggcccaggtgggagacctctggacccatttctgcaagtcccaggttcaggctgtacttgcaggtagctgtgtagcagggtgcatttttaaacctctgggattctgttttcgttcttttatacctgtttactgaacagttgtgaaaatcttaagatttcacgagtgaaggaactttggaaagtatttactgttctgggggtcagatggtggtattttgaagcttcttgtatatttatctgcaatatgcttattttcccttgagaataactgagctcttgccttcatgtgatcagttccttaagaaccaggctgtttggtattaaaatgtgactctgagccttcaccttattgcattcagcaatagttatgtatattggctaggaagcttttcctcactggtttgaagtcagtgtgttagctataaatagctattatttaagtgttggcccagttaaagatgtaaggaacccatgttctctagttatgaagaaccaagaaaccccaaattgttagacttgcctaaaataaataaaaggcgagaccccacaggggtgaagtgtgtaaagtaaataaaggacagacctcccaggtagcccttcagttcccgttcaaccagtcctgaggcaggaaaaggatctgtgtaccctgatctgccacgcacttttctattctgcagaattggatcagtgcgtatgtgaacattgattagtgagggcaggggtcccactggctgcagccagtaccttgtagagctctgagaatgcagtcaggccactttaaggttggctggagttggagggagatcttatgctaaagtcacttgtgtggttgattaaaactgccctatcattaagttacccactggtttgagaaaacaacaaaatatattttttaaataaccttgacatttaaaaattttatctgaaaagtaaaaggtgttatcaagggaggcagcatggagtagaaaagagatgttgaatgtggtgatgagggccaggaatgaccttggatgggccagcccttctgggctgtagttgggcttttttaggatatttctagggcagtccagtacatcccttagtggtgatcatatatgggcatgaggatgttttgaaaactcataagctctttagagaagggaggtgccatatgaaacgtcattaagtggagagttgttcacgaactaggtaggtagttactttggtcttgccataggtttttggctgtttctgatgagctactgattgaagacccctggggtaggggtgaggcctgcattctgggtccaagtctaagagtggcgactagaaatgagcaagttatttaaattgcctgggccttggtttcttcatatgtggaatggggtaaagcctgccttcctcatagggctgttggaagatgaaaaggaggaaggaaaagcaccgtgaaaatgttaacgatggttagaaggtgggctctgctggtgacagacagagccttgatatcacctgttggttggtcacctgcttccccaaggccacgccctgcagccttctccttgaccatcccagccctgctgatgttccttgtgatttcacaatggagtacttatataaaattggtaactgctttccgggaaattgacttcccttccccttgtcctgaaaactcaggcatgggcatatttcttggagattttctagttgaatcagaacttcctcttggtttgcgtagattccatttagacctgcattgtccagtgtggtagccgcttattgagtaagccacgtggcttattgagtacttgaactgtggcttgtccgaattgggactgctttaggtgtaaaatatacactagatttccaagacatagtatagcaaaaactctgtacaccatttcattaataattactatgttgataacatgttgaaatataacattttggatatattagattaagtaaaatgtgttcttaaatttcacctgcctgtttcctttttattcttttttttttttttttgaggcggagtttcgctctcatcacccaggctggagtgcagcggcgcgatctcagctcactgcaacctccgtctcctgggttcaagcgattctcttgcctcagcctcccaagtagctggaattacaagcatgtgccaccatgcccgtctaatttttgtattttaactggagacggggtttcaccaccatgttggccaggctggtctcaaactcctgacctcagatgatccgcccgcctcagcctcccaaagtgttaggattacaggtgtgagccaccatgcccgactctttttaattcttaatgtggctacttgaaaatttaaaattacagatgtggcttgcattctgtgttggtaagctgctttagagcatttcttttaacaccaggagttcttcccctcatcatctttttggctgagtcgtcactgcagcgctcatagccccgcatgtacctctccagccagaacccttaggaatcatttggggagctccatgaagggcattgagtccaggcagaatggctaccttgagttcaacataagcattaagatggccattcgaaaacattaagcacagaagaatcccattcaggtaatcttctgttggctggctgtagaactacggagaacatctggagaaacacgtcaagggtgtgtgtgaaatcgttgagcctactcgattttgtcgtgctgttgcgcggttttcacttggcactgtcctttaaactccttctgtgccgtgactctgcagtgtctggcagcgtagtagactctactccctctatggacgtgatccctctgtgggttctctgcacacttctgtatttctcggttctttttggatttaggagtggattttatacatttttgagtcattcctaaagagcgattgacccttaaagaactgtgtacagtggtttcctttcagtaagaacatagttgtgtggcaccccctgacatgtggtgtggttgattcttcttccttgtcttccaacgccaccctcttatgagtctcttcctacccccacaggtgccgcttctctgtctcccttccctcagtctggcttttaacggtggtctcctgacatagtccattcaggctgctgtaacaaaatcccataccctgagtggcttacacacaacagaaatactgctcacagttctggaggctggaagtccaagttcaaggtgcttaccagattaactgtctggggagggcccacactctggttcacagaagcaccttttcactgtcttcacatgttggaaggggcgagggattttttttctggcgtcttttttataagggcactaatcccatttgtgagggctccaccctcatggcctaatcacctcccagagccatcatactggggattaggtttcaacataagaattttgaggggacataaacattcagatcatagcatggctggagttctgtcctgggctctcttttcactttccttgttctcatctcatccactggtaactgcattgcctcctgtctccacctaaacttccaagtatctccagcccagaacccttttgagtccaggacctgtcattcatatccatcccagaacccttttgaacccaggacttgtcattcatatcagaccaccacgagcatttcactacagcctctgatggtcttccctgtttcctcacttttgcctattttttttcttttctattccctcttaagtgggccacacttttgttcccctggttcttatgtcaggaatgtgggtgtcctttggacacttccttctccagttggataccaggccctttccctcccgaatggaatggaaatgctgcttcagctgtgttcctctgctcctcccccttacagcagtgacatagcctctctcctgctattgtgtcctgtggctccaccgagcactggggagcttttcagtatgcacttttttttttttggagaaagagtcttactctgtcacccaggctggagtgcagtggtgcgatcttggctcattgcaacctccgggctcccaggttcaagtgattctactgcctcagccgcctgagtagctgggattacaggcccgcaccaccacacccagctaatttttgtatttttagtagagacggggtttcaccatgttaaccaggctggtctcgaactcccgacctcaggcgatccaccggtcttggcctcccaatgtgctgggattacaggcatgagccactgcgcccggccatctagtgtgcactttggactgatgagctcccctacctgaaatcctgtagcaagtccctataggataggcatgtggtacagtgtgaagctcctgagtggtcaacagctaccccgtgacaacatgccacactccatgtgccactccctcccgcctgcctgctgtgtccttggccccagtggtgctctcccgtgctgaccagccggcacggctcacctggccgaactctagccttgccttttcctctcaaggatgtaaaggctctgcagatttcgggaggcctgtctcccagcacctgatgggacactttttgccccactgtaaattctgggtgtatcctccactgtatgctgtcaccccaagggcaagcactgcatctgcttagtgaaggatttattgttcggaagatacattttccccttgagcagagagtggcgtatcctggcagtcttcggtgagccagttgtaccaggattatgaaatgcagatgtttactgtgtcattgttgctgtcattgctactgaggagtactgaccagaatcatctgcaactcttagttggcagagaggaccactatggcgggtagctcttttctttcctgccattgtggggatgattccaggccaaagatgatggagaagtatggaaatcatctgaaaggttgaagcttggcacgtgaagccattcatgactttgtaaggcagttttgctgaaggccagttctgccctgggagggacggaggtgaatcctcctgagtacctgtggttttcttacttcctgctgaatttacctaagtgcctgttgtttgcttgctgtggaggctttctggtatttcatttcaggtgcagatgccttcactttcccacaaaaaaaaccccaacaaaacctaagaccttactgcaactaagtctccaagtactttttaacccattgggatgaacagcctgtggtctgctcagatcaccctgagtgcgtgtgagaaggcctgggctttgccaggaaatccaggaaggcagggccgggctgtgttggaagctggcttagctggtggggcagccttatttcaattaaaagggcattgactgggagcagcagtcctggagtttgttgcatttcctattgccctcaaaatgagaaaccaggaaaatagcagattggagccttcgagaaggcagtaaatggctgtttttattgacaaaaggaaaacattttactgccatctcactgatggcatctcactgacttaaaatgaaggcaggttgtagtaaaaaaaaaaaagtctacatttttccaccgccacgttcttatatccttgtttgtcagccactgctcacaagggcagtgttgtcttgcggagtagaggcgctctccttccctcgttttcctctataggttggtgtggctgacctgctagatcaaagtggaggacctgtttaagaatgtgtaaattgaaggctgggcgcagtggctaacacctgtaatcctagcatttggggaggctgaggcaggaggatcgcttgagtccaggagctcaagactggcctgggcaacatggtgagaccttgttcatataaaaaaatttaaataattagctggttgtggaggcacgtgcctatagtcccagcactttgggaggctgagatgggaggatccgcctgagcctggggagatggaggttacagtgagccgtggttgtgccactgcacttcagcctgggcgacataatgaaatcctgtctgagaaaaaaaaaaaaagattttgtaactaagttttatggctagctttgagaaaggaaaataataataaaaaaagaatgtgtaaatcacctgctggatggggggaagaggggcacattgtctttgtagtgagacttcactcatgtgatgtgcagtatttcatcttaacattttttttttaaacttaagctacttgtgaagagctgagatgtttctgttaagcactgtgtggtctgctgctggtcttctgcaggccactgttccccagactgctaagacgatcatgacacaggcttgcattttcaggtggactcttgggaggggcttgtggaccctggaggagaaggcagccaggagaggggcatctggctttgtgttgttggtaggaacttgtctcggttgccctggaaggcctctgctctggtcagctgctcccagtgtgggggtgatctttatttagaagggggtcacatgcccccaggcctcattgctatgccttttatagtcaggcgtggagctcacattctcttctgcctgattgccgacgcttgttgccgagatggtgaagcagtttgtgtgcaggttccctgggacctggcttagcccacctcatttcttggggcgtgtgccttgtgcctcaaagactttgcttttggctaattgtcattagtgatggtgtcaccatcctgggcctccttcagaagtttttaatagggatctcgtctaagagaccaaaaagctttcagaaccactgacttgtggtgatttttgcatgccaagtatttggaaaatatctggagccccttcagctctcaccagttaaacctatttgtacatttgttctggtttcttcctgtgcttgaaaagcctctttctttgttgcgttaatacctctgtcttgctttcctcatgtgtatgccagtgtgacattctcggcagagtggggatgacgtggagcgtgtgggcccgtggttaatcttgtcctgaattgccttgctcaacttgcgtgtatagggtggttcaaaagttaagtttggctggtggtgaagttggaagcatcacttagaaacacgcctcctttgggcatatggtgtgaatcagggactctggctataaaaggtggggtctctgagcaccatcctggttggaatgttcccctgacttggaggtagcgagagacagccaaggtgtttgttccagggaggctggtgggtgggagatgggatttttctgtctgtggcacaggcagtattaagtagagcaggctgtttaaatcacattttaagtaaaaaccaaagtgcacagatgatctgcagaacttctgggggataagaagctgctttcctcgaagaagttcacctccaaaccagcgcccatggctcagcagccagcatggcagccccaggggtacatgggacttgggcatgtgaggctggtgagggacagggacagctgggtccagcagtgcctttcctagggacggttgccacgtcacctgtctgccctgtacttccatttcctttctttgaactcggggggcttgcatcggactacctgtgccgtttcctcaaactctaaaattgagtaagttactgagggtttccgtggtctgctctgagaagatttcttgcttcctgatctgcctgtgtgttcgtgttgcttggtctctctctctgtctctctctctctcctctttgatcctagtacatacaggcaaggtatgcagcatttaaaatgttcataactcatcaaatggcacactgatcatcatgtataatttgggaatcagggtttaagaaatttagagatcatttatatggaagaaggaaccccaagtagaaacccaaaatctagaccattctgggttctaatctgtacctgccactggctaacatatggctttaagctggatgttacaatgagagctggagtttcgtctgattgcacatagccttgcttttctgtctttggaaaagtagctcactgcagagccctggtaaacgtttgaactgcattgcgggagtaggcagaagaacagaacagtccttggagcttggtaggaggtgtgagggcttatgggggacagttgtcttttcaagtcaaggaggaataagggcttctggggccggtggaaagggtgagtcttaggcagggaagggtgaccatccaggttagatcacttcttctgcggggtcagcttggccgctgttaggttttcaggatgtcatggggctggccaggcctcacccctgatatccctgagcatctgttccttacaatattgtggagtccgtgggggcagaagctaccatcctgtgcctgccctcactctcagtgtgactggtcttcaggatgtttaggtggctccacatgcggatgtacagctttcccctgcttgttttccccatggcatattaacagcgagatctgcaagaatacatcattttgtacagaacaggatgtatttcttttaaactacgttcctgtgtggacaagtggtatcatatgcaaaggtttaaggaccgttgatgccttgagatagtgccatctgtttgcctcaggtatgtggtgctaggacaaagctgccagacctcaccttccttcagtgagacaggaataggacagtatttgaaaagcatctaacatgtttccaagcacataggtttttggtaaatggtggcagctgctgctattttttttttaaattaaactatctaagagttgcattctgagaccatctaaaattctgagtcttaagctgtgttgactatatatgttcactaccataactaaatggtccttctgtattgcttttctaaattgtagaatttcaattattgtaaatagcgggccatactgtaggtgtggttcttgctaatttgattcgtactgttcaaattcttgtgtctgtccagataaactgtatctttacagaacattcagcgaggtacatatgtctatatcggggtgccagtggagtcaccctagtcatatgtaaactctatttatttggttccgaaactgaatttattttgtttgcaagtttggtatttgggagcatttaagaaatatccatagattcttgtatgatactgacattaaatcattaaataccatattttttaaatgcctctgtctgtttgcatggataacattaaagtggttagagtgggcacagttattggtaaagattacaaagatgtgcatttttatgacaactttaggtctcacataggtagccaaccatctgctccaggatgaagcatgtgcctgtttatcctcttctttggtaacgctaggtatatgtgtgcacacgtgcacgtgtgcgtgtgtgtttgtgtatgtgcgtaccactttattctcccacccagcctcttctcctgttttgtttagtttcattttcctcctctcacccccattgcaggaaacaaacactggctctctgtcctcccttaggtcttccttccgttcaaggggatcaggtgggtgggaaaatgttgtgcaggaatgccaggcctctgcccgaagccgggcttctgtttcatctcattattgaacagaagtcgctttttgtttctttgccttggtcacaaacaagcgcccagtcctctcttctttcttcctgccatttttcccagaatccatgtgggatgggaacagaggcagcgtatttagggactgtcggttgcttgatacccatggccttgtttagagaagctgcacccactgccccaacgtgtagctgcatctgatttgtttttgcaagtcctaatgaagggacctggatgaagttagtgaggttgccgttcctggggttaatgcagagtggcccatggagcttagccacccttcatgcagaaggtggggctgagggcagccagtgtgactgaggctcgctggcccaccctgagctgcttgtgcccatggggcccctggggaggagggcccagctgcagtgcgcatacatctgcccttggcagcagatctgtgaacccaggctgccattctggatttccggatagatgcaaagtgcttggacgtgttttagcagctgctgagaccaggagttgggcttagtagtaaaaagggggaacaaaataaaagaagatcaggagacaaagagcctacagtacaaaaaaggaaagacgaaggttgatattattagaaatacttcctgggcagccttactgtttgaattaggatcacccccacccccacctcccagaggtattagttgtaatgcagagacaaatggaaactagtcagatccttgggtcctagaaaagaccagctttgttcctggggtggtaacctagtacaacgtttccgttcctatttcttgacctctgaatggccccttctgctttgctaagtagatgatattattaggtgcttagactattcttcagataggatgtaaggatatatttttgttctcttcctcagtgaacttgaaatgattggattattttgtaatacgtcgatactacttttagaagcttttgaataactgtgtcaaagaagctttagaagaggttttaagcaggattgcagagaatgtactgagtgtgtttttccactcacaaggaaagacagcagctgaatgcagaagtgtgtgtctggttctaactctttatcacttcagggactgtccaggcagcaccatccgttgggtctcctgcccttcctcctcccacccctgccttacccctggccattcttttgtgaccagtagtcctttatgaatggaattctgagaatgtataattttctcagaagaatgcttctttagctcaccaaatatttcttgtttgctgaggggggaaaaagatcctccttggaaaagtcactgggtgccaaaggtgggtgatgaggagagatgaacttctgggtgtgcctagcaaagctgtttctgttgataggcgattaacaaaacagccaaacttgacctaacagactgccattttgagaggaatttgttttgcaggattaattggcttcgaggtgtactggtggctgtgcagtgatgacggctgtcgtgcctcctgtgtcttctgctcattgtgatgcagggcaagtgcttaggcctcagacacaggctccctgaacttcgtgttcagtgctttagggtggggggacttgagacccttgacttgactcggtcccactggaaagcttctgttgcttatttgggtaaccccaactctatcttattgggcagtagtgttatcctaattcttggaaatactcagtgtagaataaagagctgatgaaaatgtgtaagaagggagtaagtggtcattagagagaaatggtaattgggatgatgctctgaccccttcagcaaaaaataaaaggtgaatggtttattatgagctagttcagattctgtttttggaaatgagcttggttatacatagtgcatttgaaaagcgtgaagcatggactttcagatgccagctcctcagcctcctgtaactccagtcgcaaaatccctccagtgtatctaaataaatgcaaactcatcagtgccttaccattataaagctgggctggagaggcaggtggcctggagaatcaaatgacaagaagtatagggagcagcccagcttcatgatcgggggaatttgcatgaaaattgtgtacacttaagcaccattgtctattgcagaaagcacgatctggcctcttctactgactttccttccagctctgagattcagttttgaagacaaggttgttggggacctcggatagatctgttggccgtggctttcagtaaacactactagagactgaggacatgttctagacttggaatggtatgaagcagtcgaactttttaggatgggccctacccttagggactgcctacgaaactagatctagaagaggaggctgtggacattaggaggtggctgcaattgggaagttccagagagcttactgagggataacggatgtaggacaggaggctggcaaagcacctcagtgatagggcagaaggaaataaagtggttagggaaggagttgagagcaggaaattcaggtaggattgatgttaagtcttagatctttgaagtgactttctctggtctggcttttgctgttaccaaagtgaattattcataagtgcatatgagaaatgctgatgtaactcgattatgtggaatgaatttaaattcatttaagtcattcttttccactaaagtaagctttccctcatccagaatctgagcagcccgatagccaagcaggagtttccttgtgccatggccagtgattgatgtcttcttctatgatgctgctgaaatgctggggactctgaagcgcagctggagtgatcaaagcaaaattaaaatactttctcagtggtttgggagttgggtgcgttctgctgtattttttggttttcggcatctgggtttggtgtgcatgcatggtgagctctagctggagcagacgttacctactgaggctacgctcttcgtggtttctccttaaccatcacccacttgatcttccatgaagccccccaaatcttccttactgaggactcttgcttccaggttgcttttgtgctcatccattgctgggttatttggtcagtgatgatggtttctctgtactttttatcagtaggttcagaggaccttgtttactcctcattcatctctctccccaaacagttgagaaaccacttgtgggttaggactcatgctttgtttataatgtttgattctccaacctcacagctaatgggaagcccgtggaggagatactctgtaaaaatccatctcccatgtgggcttgaccccacttagtgtctgagtggtttggtcctcatagttctcttgggggaggaggaagggaaggaggaggaggtggcgatggcagtggcagcagtggtggcatcttggaccagagtgagaaatcttggaccagagacaaaagaggtcttctctcagggtagtgcaccatgagagggagcacctgtttacattttgtatcctggacaccaatcttgccttgctctggtgctggccctgagaggtgcaggaattttataaagagatttacaaaacatttttggatgaccaaattggtccctggttctagctggaatgaataaacaaactaaataacagtagagtgtgagagtaagtgtgtgtgctagagaatgtgtgcacatgtatggcctaggtgagttcttcactttgctgacttgtgaattatttggggtcctatggtcctccccatcattcttattcatgtcagtccaccatcattaaggaagtggaagcgaacacattgtgtacatatcactcccatagagagggagactggggaagaggtttgagttataagtcgcacctaggttaggtctggatgtgtctttgcaggtttccttgctagttccttggccagagtttccatcgtgtccctcagctgcacaattaaggtgcccccgttttgtgcaagtctcatgctaggcagtatgagatgacacaaactaggattctgttgtgagataagataaaaacacttgacatttaaaagagagagacaacttatgcggtgtgacgagacactctacgacttttgccagaagagaaatagaggcaacaagtgctaggagctcagaggagggtaagttccacatttggaactttggattaaaagaatatttgggtctggttgaaatcgaggcctttcatgagaaatgtccacacttgctcagtactgtttgccgaacactgtatacaaggccctcgactcgtgaatgagttgtaatgcaaaactttgccaggcatttggaatgtggagtatactattttgtaaagatgaggtctgaatggtggtttaggtcccaggccagtgtccctctgccccccacctccatatgtgccctcaagccggtttggcttagacattatttatctctgactactgtgtacagcttagttccatggggaggaaaaggcttgatgaaccctaccctggaaggctggtggctctgttttctgatggatgaggtaggagtggtggaaagctggtagtttctactttgtgcctgtttaaaaagccccctctgaggccttagcacttaacagatgttcaggattgggggaataaaggagctgcctttgcagaggtctgtgggcatgcagtgggtgagagagcaggcactgagtgccccgagtttcctgcctgtgtgggcaggaggattctcagtggaatcaggagcatctccgcctggtgctggaggaggtgtggagttgaaggtgggattcttcctcttgaaggacttgaatgagtttctgtgtggctgaacagaaactggttcaacacccatgtcatgatttttgtgaagcgaggacttggggtcccaagtctaggttttaggttccctgctgtaacccgtggccaccgagagagagttttatgataaaatgtcagcaaagtacctgacaacgtctcacgctagaatgagtttcgtacatgtttagttccctctctttttattccacgctcccccaccccaactttaaatcagaaacgtgagggtgctgattgaagctttttataacttttcttattgagaattgttctctggagttgtctccaagaacaaaggaattccagacgttctccttctctccttgtctcttctgtcctccagtcaaagaaaaactctgcatatgatctttggcctggagaaatattaaatctatgttaagtatgcagacatgaatgggcaaatgaaggatttgtggcaaagaagatctgccgaaacaaataagtcatgtaaatgggcagagggaaatattaaattgattgcatctttcagctcctggtacttaatgcaaagataaagtagtgggaaaaggttgtcatttgaaataatggaaagatgagggagttttgaagctagctgggatttttctgcctgttaatagagtgacttggattacagactataaagataaagagtagggccgttgcatttagtatggatcatgatgctgattgctgtctgagcaacctctgtactaagggaggagaagctaacatccccgggcctggaagatactggatactagctcattaaactcttgtgagaagccttcattagcattatgggaagacttgctgtatctatattatgaaggcatttagattttttttaaaatgcatgttcttaacattttttgtttattaagtggggcagtagattaggactgaatggatttgattctctcatcctacatagtgtgcccagaagccagaaggtttcccagaatttgtattatggcagcgagggcaaatttaattagcagataggaaaagctttggagcagtttaggccaatccatttaattgtatcagcaattaatattttgagaaaatggaaataattaaatttacatttcttctaggactttattttgttatcctttaaggttattgtaaatgaggagacttttgaactcacagactaaagcaaactacaccagataatcattaactttttctattgtgtgccacccttcccaaccagattgttccatagtatcacttatgaaccaagaacctgtgagcttgcaaaacgcatttttaaggagtctcaacttttctgatttgtgttaaagtttaggtgtgggtcccagaaatgagtttcatggaggggagagcttgtctctctgggtgggtaatacaggggccactgggggctcactgtggctttctggcacagacagttatgaagcaggggttactaaagtgggagagagcagccagttctccagcagccccagtgagagctctcatggatctgcctattgcactggggtaggagccatcaccgtcagcttttctctggcccacagtgccattttctgattaagctgagacctctgtaatagacacgttgtcattttttcttgtgtctaaaagtttgcttgactgcagtgggtctccagctcagagcaggtctggctagagaaaacaggaggtgatgactggagcactttgcccttatggaacgtgctctgatgtagaaagcaagaggattttccttgcagtcactgaaggtaccttgtgtacacagaaagaagacagagggagccccggatgcctcggtatccctcagagccggatccttcagacctgtgcagtacctgtggatttggttagtcgatgatgcgctgccattaaaacaaaggcatcggccctggaatagagaagttcagtgagaacctctgtactccatgggcattttctaggaaataatttcacctgccctgtgtaattctctggaagaatcacagtgagttggaaggaaacttaagacttggaaaaggattgagaggttagcccagaccacaccagggctctgaaggcccagctggggttagaacctgggacaccctccagcccactgtctcctgttccctggccatttactgccccactcccctttctactctcaggggccctggatctaatgaggggattcgtgcagtttgctgcactaatacattgcaagtggtgccaacctaaaggtattctgatggtggaatcagagcagtagcatcttattaggtcagaatctgtatctcctcttccaagatttttacatgatttagtgttttctgaattggaaaaaaacaaaaacaaaaacacacaaaaaaaccatgtctaaatcctagcatttcatcccatgttgatgaaagggcatcttttttttcccctaatctgtggttagaactctcagaaacttttagaagatccctcctatgttttggaggtttgcagatttgaaccccagttcctcccacagtgcttctccaactcctggaatgaggtaaacctccaggcagcctgttgacccaacccatgcatgccggtctttgggactcctagatgtggaccctggagtgaatagggatcaggtgggaaatgagttcctttgatgaagatccttgtaccagtgaactgaccccactccccgtctggattcctgtggtgattaccctctgtattagtctgttttcatgctgctgataaagacgtacccaagactgtgaagaaaaagaggttttaattggacttacaattccacatggctggggaggcctcagaatcatggcaggaggcaaaaggtacttcttacatggtggcagcaagagaaaatgtggaagaagcaaaagtggaaaccctgataaacccatcagatctcgtcagacttattcactatcatgagaatagcacaggaaagaccagccctcatgattcaattacctcacctgggtccttcccataacacatgaaaattctgggagacacaattcaagttgagatttgggcggggacacagccaaatcatatcaccctcttagcaaggactgtgttcgtgatcatgactggcattcactgaacaatgactaggtgccaggcacctcgccagtattctttaatctttgcacagtctgtagggtggatatggatattactgttccattttttgtggaagaggaaatggaggcaagagacctgattataacttgtgcaaggtgccatgcagctaagcagccagcccaaatccagacctgctttcctatgattttcctgcccattactctcccatcgtagctcacctaatacttcctagtgggctgctgctgaacacacacccagggatgacttagtggcttgtcttgctctgaagaaggctaggcaccatgttggatgagttcttgaagatgtcttgctctagtcaagaaacttttaaatctttggagtttttgtccacatctgcctagttcttagtaaacatgatgtgggttctattagcatggcgccctccctcccttcctaccacctttatatgagcggagaacatctatgactcttatgagaaaggaaagatgaaaatcagagtgacatagtatagttaaattgcagatgcttaattataaaacagcttgtttctgaattttaattccttgcttttctctgactttttaaattcccctccttaggcagaattcatttttacattgatgattttttttttttttttttttttttgagatagagtcttgctcttgtcaccccggctggagtgcaatggtgtgatcttggctcactgcaacttccgcctcccgggttcaggcaattctcctgcctcagcctcctgagtagctgggattacaggcatctgtcaccatgcccggctaattttttgtatttttagtagagatggggtttcaccatgttggccaggcaggtctcgaactcctgacctcaggtgatccacccaccttggcctcccaaagtgctgggattctaggtgtgagccgccacacctggcctgatgaattattttcatgtgtggaacaaaactttgatgctgatcagtgattaggtacctttgtttggttcatttttaactaaggagatttctttctttttaaaaccattctttaatcttgtaaaaatatcatttaatgggtggatgttttagctgtgatgaatgacaggttgtcgtaaaggaagaaaggtatgtggtttccagtaaacttttaattcttttgcaaaataaaaataacagtcgtacagagagtaaaatatatgaagagtcaggaagtgatttatcaaaatcagatcttggactgctggttttaccatgaattaggctcttggaaagtgattgggccagtgtaggtttacattttttttttcttgttttatttgtcaaagcaaacttgtggttgcctgcccgtagtttaattctgcctcctttgggcaaacaaccgacttttactgggagtctttctcagggagataaaggtgcaccctgaaactctgctctctgattcctcagcaaagtcagtcctgagtatggggcttgggtgtctctgcaaggccttgcaagtgagatgggctgtcacctgagctcaggtggggctgctcctgccttggacagcctccccagcttctcctgcattatacccaggggctggagggcagagagcaggtcttcttctgctggtcggggcagtcacaggctttcctctcggcctgcttgtcctccgggtgggtccagcacccgctgggattcctgtgggcttagtcactgtgtggcggcggcagaaggactggggaaaccgccggccggccctggtgcgctgtcaccccgaaggaatgcgggccaggccggggctgctgggcctggaaagttctccagtccctgttgcggatctggcctgccgactcaaagtaaatctctcttcccctttatttcccatcaaataaaaaaggaacacgaggtagccactgtactcactgaagatgcattgttttttttttttttttttttttttaagcgagcagcagcaagatttattgtgaagagtgaaagaacaaagcttccacagcatggaaagggacccaagcgggttgccctgaagatgcattttttaacttgctttttaactaagtatttttgctctgagctttcctggatctgtaaacacacccccagctattcaagatgggcttcttggtgaaaagtgatgtgtcctaggagaaatcacgcctgttgttgccgctggccatcacagatcccggtgcctgtctgtgaaaggctggccgggctgggtggggatgagaatggtcgggttgtctagactcagcctggactgtctttgactggaggggcctgagctcctcctccactgctcaagaccccggttaaggggacagcagagcagggatgagaagtggccctcttcacatcacctcccagcaagagggcctgacttagtgctcccaccattgccagccccagtttcagggtcccactcagttgtatttgaataggtctcatgacatgtgctttgcttgaagagcggctattagcagcagacgttcaagaggctgagctcaagcaggtgagcatgttctgagccattgtgaacccagtgaggtgcctatgctgatgcccagggccgcctgggcggggtcaggcccccatcgcttcttcatcctagctctgggagtgcattctgcactctcccgaggccagctggtggcctttggtgatcaccctctctgtaagtttttaagtggcttcctttcctctggtggagaagccagcacctttatcctatgacaagaaagctctttgtagtaggtggtagtagaatcagacagatctggcttaaaatcttggctgtgctacctcttggctctgcacattggtgaagagaatttaccttcctaaggcctctcagctacacgactgtggacactcagcttccttctaaggtcgttgtgagaggtaaagaaaaggggttagtccagggccagacatggcacaatgcctcaatgaaatattagctgatactatcgtaatttttaaattcccataggactcactgttaaaggattacaaggctgacacaaaaaatactgcattttgaatttgtgtctgatttatacatttccaaagagtggaattctcactacaacagctgttctttgaaaggttagatctttgttctgagataaattaagtggaaaaaggtgtagagcattatatgtactctgattcttcagggcttaatttaaaaagagcatgtttgctggtgaatgctggttcaatcattaagaagtttttgagaaggaatcccagaaagtaataagcacttatttttcatggaaaggaaccggaagtgcttggtgacctccacaggtaatcttgtattatttttgcactgtttggaattttttaaccatgtgcttttatttcttctattcttttcaaaggtcagtaggtgttatctggacaatagggttctggtctgttttctgttttcttcattgtactgtgcattaagaaaaaccctaatgtgcttttttttttttttaagtgaacctttccacatctcattgtccttcagtgagagcaggctgtgtgtgtggtcttggtgaactgtcccgttccctggagacagtatctgggggcctccctgcccttcccagtaagagctgggccttcacaggaatagaggcctaggattcgccttcatcctcttgaagagccctaacagtaggtcctggctggggtctggcatagaatgcccttggcacgatgtgtgtgagtgtgtctttccttagtaaatggccttgaaaatgccatgtgcttctggcaggcctggataaggtttgccctgcataacccttggaaagcacagttctcacttgtaacaccctgtctgcaggtccatgatattgtaattaaaaagttatgggatcacaagggcctatttaaagggcatctggtctaaaggcacagttaaaagcagaatttgtgtcagtggctcccttaatttctcaaatatggttctgtttctaaattcatcccactggatgtctgtgttgagttttctgttgatgaaagaatgtttaaaaatgaggcagatccaaattctaatgtctgagtgtaccactgcttaattactttgggcaggtcacctcacctctcttggaaagaaaggtgatatactacatctgtgattttcaatttttttttttttaactagacccacagtaaaacatagatatacaccatgatcccaggacagaataagtatataactaaaataagtgttttgaaatcacttcttgtctgacacagcactcacgctttctattcatgtagtaccacgatactttcttctattctaatgctggtaagagatgccttaaactgattttgagaactaccaatgggtagcagctagcggcttaaaaaggatgttattaaggtccttttcaccctgattttgactctgttggctctcagctgagtgccccatacttagtgcacatagagttggcctctgaggtcagcctcctgttttcctgtgaaaatgaggatggaagagagtcacttgtttccctccttcatggctaccccctgaggactgggaagaatttaagaatttgagtatatgttcccaatagcatgatgtgtttcattgttcatctgtaagcatttttaaatattcgagatctgtatcttgggtaatttttatcaactttttatttgtaaaataatttcaagtcagttattaaagtaacaaaaataatggcaaacttgataccttcccgtatttttttttcatatttttccttgaatgcttacaaaaatattaaagaatattatcacatcattgtagtcaccgatgaattattttctggtggcttatgattagaagagcttgactcggagtggaaacagataacatttgagtgctctttctgttaattcatccttgtcaataaccccattagctaacttccagcaaggctgtgttaggaatgtggaatcaattagatgaattttgaaaataacttggtctgttctaaaaggccctatgagattcaaactgttgtggcctggtgcctggtaactttgatggccattttgaaatgttaccgtagtgataattcttctggaatctcaagtcattaaaagtgatatggctaactctgggccctgtgctataaaaatagatgtcatgggatgtgtgaatcctttcttcagtgttatagttaatagcaactgaaggaacgttttggtcaaatcccgaatacttattaggggctcactgcttggctgcatttttctcctctgcgtaaatcatctatccatgtaattattaacccctaagaatgaatagcatttttaaaagggttccattttcccctcatatgactttggttcattctcctccttgtttctgtctctcagtgaactttccaaaagatgggttatgatgaaagatgaatcgtcgttgataactgctcttacttatctgtgtatcgaaactgcaggtagtgctcttcagctctgtggctggatttagtgcctcttctagggaggggtgggtgttggcacaaagcgtatcccatttccctgaatgtcgtgtggacacgtgagaggacagtgcaccctttgggcttggtgctgcccccttcacgctactgaaccccagggtcataattaaaagctgtgttagctcttctctggttagaggcatacaggttggaggcttgtacatagacgtgagccggttggtctaggccaggaagcaaaccattggaaaatgtggttagcagtgacagttgacagcatgtttgcctgcagtagtggtggttggtgctgcgtgttgactggagttgcttgcattgggagagcctgacttggccaagtgtgtagcttgagaccagttggattcctctcacagagacagtcttcacccccaagctctgggtgttgggcgtgcagcattcgtattcagcaaacatttgctgatttccgcctctgcaactactgagctcagctttggggatctgaagatgaatagacacagccacacttctggggaaatctccctgtggggaggctgacatggaaaccaaccaaatgggagtgtggtgcatatcttattagagctttgtgcaaagtgccacaggaagcaggagaaggggtagattggtgtggagggggcaggggaagacttgcctaggagcagggcctcgcaggatgcagaggagtttgccaagtaccagagattgtggggtaggtgaataaaggctgagtataaggataagtcaattcaggcagatgtcctctaagaatgaaggtgagaatgctggcggaaaccagttgtggccctgtctgccttccctaggagactggacctgactttacaggcagtgacggtgaagcagggcagtgccacgagcagatctgtgtttcctgaagggtctctggcagctgtctggggaaggagggaagctggcagagccgtgggtggaggcagatgccattgctatggagtgagcatggggaagggggtcggaggccttttggagatagatacagcaagacttggtgaaggatgaagttggggcaggtagaggaaaagcaatgagcttacggatgactggagactgactggagaagatgaccacccttgccattaactaggataggaaacaacaaagggtaggagtttgacaggggagaatgtttgtgctgttgagttgttgagtttaggtgcttgtggcacgagcaaggggagtgagctggtctaggaggtttttggaaacactgacctggctgcagagagggagatcctgggacacctgttttgggagttatcccagtggggaaggatcactgggaagggggccacccctttgggaggggtcagtgggacgactcccaagggaagaggttggttatagggagttaaaagaaaggagcacccctcacgcgagcccatttttcaaggatacatgtttgtcttttagattctataaggagtagctgctacacagaaagatgtctacgtgtgggtgaacacctggcgtatcccatgcagggaggcttcagcagaccttggtggcgatggaaccaccacagtgatccgaggattgggtctgaaggctcctccgagtctccaataaaaggggttgttttgaagggctcaggttcttcctgggcttttttgggacagtcttgctctgttgcccaggctggagtgcagtagaggcaatcatggcttattgcagcctcagcctcctgcctctgggctcaagtgatccttctgcctcagcctcctgcgtggttgggactataggtgcatacccccatgcctggctaatttttaatagagatggggtcttgggctcaagttatcctcccacctcagtctcccaaagcgctaggattacagacatgagccactgtacctggctgagaaggtttttttttttttcccccttccaaacccccatgtggtccagacgaggccagaggatctcaggggaattccctctccgaggagcctccactgctattgcatggcccccagcatagtcatttgagtgaagagccctccaaaatcattaagctgatttgtagaatcagtttgctgtctgactacctgatgaagatgagaagtggtagacctccccccactgtaaggtcttaacaagatctaggtggaacatgggactgtttgcaagctacttctgtttctgaaatcacatgcttgggatcccaaataatctactgaaagctgtcttcgggaggcaaagcccagggatttgttttgtttgcccctaatcatctcttccatcccctttctcaaaagtcttatatctagataatttagtacatttgatctactaacagccagggccataacaggagctgatattacataccccggaagtcctttgcaaacacactgtagtggcgattgattagtgttccgagccataggtaacattagcctgcctcgtaggaccctcagatgctgaccgtatctgctgcaattcttagatgtaaaagagcgcgcatcgtataaatcaaaactagatgattattttcatttgaaattgttgttgcactgtaatttctcagggttttgtattttccaacagtggtgtcacttaatgggaagatcgctcaggctttgtaactgggcataataccaggtattctcgtttaggcattctgctcagtagtattaacctgaagccataggacatgccaatgtttttttccgtgttttttaaaaaaattaaaatggttggctacaaatgcatccttttttacttcagagtaagtcggccttggttaagtcttaatatttctcatgcctatttttttttcttcaaatgaaaacatacggagagaaaatagcatgtttatgccttttggttgtacccagcactgcccagaatggcttacagagtttatacccatggaggtttcgtaaaggtgacattaacttcgcagtaaagtcactgaccccgaacctgtgtcacttcaggcttagccaaatgctaacagagcagctcaaagcttaagcagaggtatgtgcttgctaagtaagtgtgtgttttggactaattggtgactaccattctgaacattaactgccctttgtgttttaatgttgccaggaggccgattgtgtaacctttggaggcttccctgagtttggagaactgaattcatgtggtgacttcctatttataatgtctttgggggagctatgaaataacttttcttctaagtgtgatttttgcttttttaaaagtttttatgttgttgtcaattgggtatttcccttctatgccaagacgaattgtaggttcaggtttctatgcagcctgtatgtaaacactggccctaaagaaggactctatcactctactttcagtttcttgcattaaaacaagtatgggtagcggtatccttcttatttctgcttcctggtcctgtgtgagaccctgaaaggtcctaatggcagtgctgattagattgtggccagggttcacccacaagttccgaagctggggaaggtggaagtgctgttaactgacttgtcccatgtctggggttttgcagcctggggagaggtgaccacccctcgtttcagtccaggtagggttttatgtccctgtcaaaaatgtgttgtgtgaagtaccttgactttcatttcccagggaagaaagcccgtttcaattggctcaagcggaaaagagcactgtgggtccacttaatggaagagtctaagagtggcttcaggaagtccactgggggctccccgtgactctgcccacctgcatattgtcttcattctaaggatccatgtggtagcaaaagggttgttacaactttaaccctgcatccccaccttcaggttcagtacccaagggtgagcaatctgttccagtggcacagacctgtttcaagaggtctctagccgtgatagtgctaggccactgccctccaccagtgtgttccagagaaagatgctctgatgtgccagcccaggccatgaggttcccggcctcagtaaggaagaaggaggacaaggtggtcccttaggagaaaatgtggatattcaagaaagagggtcgcaaaatagcaaacacccactatggctgggcagtacagggttgcagaaatatattttgatgtgtgatcgcattggagctacttcaaagagcaaacacaccactttgatttatttctcttagtgatacagtatttagagagggagatactttttatcttcatgggatacttacagtggtgctctagaagccatgtactgcttctggcttctccttcctttcctccaaggctcctcctgcctcctcccaaagctctgtgccctgaaagagccttgagccattgctcagatgtcaaaattgtattaagcagacacatcaaattaaaacttttgggatcactcaccaatatggtttcctgtacagtactgccctgaggggggattacaagtagttatgcatccatttcattgatgtatcatttttattaaaaagaaaaacaatccaaccaagagaggaagtgtagccagctgcctaaagagtggcgatgatgggagatgatattttgattacattaatccatatcctgttagttcactttgcttctgtcgctgctgctggtgaagttactaatgtgaactaattacatttgctctgaaaagccagaatttttaatgcatctcagcaagaaaggttaatattatcaatttaacagcatgaatgaaacattgtgtgtattgaacttgaactgtcctaaaagcttggataataaaaacccagtggcttcttttataactcactggataaacagttattggtgagacatggataaggctttcttctctttcagttttatggggggtggtaggcagtcagcattagatgctgtctgtttacagggtgatatcgtaacttcgtgaaattggaggccacatttaaaaaggcactccttccttttaaaagctttgcaagggggctgcatatattttcctaattagtgggaatattttcttttttctttttttttttttttttttgagacagagtttcactttattgtccaggctggagtggagtggcatgatctcggcttactgcaacctctgcctcccgggttcaagcaattctcatgcctcggcctcctgattagctgggattacaggcatctgccacctcacctggctgattttttgtattttagtagagacgacgtttcaccatgttgcccaggctggtcttgaactcttaagctcaggcaatccgcctatctcgggctcccaaagtgctaggattacaggcgtgagccaccgagcctggctggtgggagtattttcaaagagaacaacaattcaccacaccccaacatggtaacagtctttttgttttagaagcatctgtgaattgccaagactcgtagaactaagatgtattcaaagtcagtcgattttctggaaacgacccagtccctgaagatagtcttttggggagttgagtgttttgagagggacaccccctctacagggacttaaaatggaatggctttttgtgtgtgcacatggtacctgcagtgatttcttgtgtttaattacttcctgcactcatctgacttacacagtggtaaacaatgaggatgggaacaggcggcagctgctctgtgccatccaccgtcttgggaaccccagcgtggcattctctctggggcagcatgttgaagtgtttggctggtgacattttggtgaccagttggctcctcattgtctttcaatgtggagattaggaaccgagcgaggatttggaacccttgcgtttgttctgccaagaacatgacttgcctctggcctgagagcagtggagtaagctgataggagctagaaatactgttttgggtaggacttacccaaaagagtgggctgagtcacagaactcccaagtttgagccctgtcaaataaattctgaattgttctcaggtatgtttctcaattggaatttttttaaaaatttaatttaaaaaagacttcgaaaagttaccttgttctcatttttcttctccctctttgccccgtccccacaatatcttagggcgaagaaaagcaggtttgagaaaagctttttttcatcatgtatttgtaatagctggagcctgctgagatgatgaggtggagtggagggagaaagagaccttgaggaggtgtggagggggaaggggtggaaagttctgtcgtcttctgtgcctctctctctctcttgctcagggtctccagtcagccctctgggtttgtgcccttcgtgctgcactgacaggtcaaagccgactcaggcctttgatgtctgctctaggagcaaaagtgattcctggtcccgcagccgtttccactgccttgtgtatgaaggtctgctgctctgaggtggatggtggctctaggcaggctgtttccgctgggtgcggttgttgctgcaggtttttctatatagcttggtcatgctcctgtatctagattaaaatcctatgacagatgggcctgcttatatctaaacttattcagagagtcttatgataggcaacaggttaccctttaccggggtaaaacatggtttattctacagtttggtcccgttgtaaggccaggagatagagtctcactagtttgccccggctgaactcaaactgctggactcaagggatccttccgactcagcctcccaattagctgggactgttggtgtcaggcacacaccaccttgcctagcttgaagatctttcttctaaatgagcgggctttaaagtgatcagtgggacctgggcaggttggctcttgcctataatccaagtgctttgagagaccgagacaggaacatcacttgagcccaggagttcgaggctaaagtgagctgtgagcacaccagtgcaccccagcctgggcaacagagtgagactctgccccaaagcaagataaaattatcccacaggattttagtcctgacttgtgtattactatgcagttgtgtctgtgtgaggctcagattcccccccatttaggatttgtgtggctaaatctcagatctcattttcaggtgaatttctctattaaggttataaaagaccaaaataactggaaattcaactctgtacttgaatacttggtaatgcccagcattctcttgactatcccatttcacagtttgccggtcatttccccagtgtactcactggattcttcccgcagccatgaaaggtaggtataattaactccagtttacattcaggacaatagaatgttcgtcaaaatgcttttgcacatgttttctcaccctgagtggctacacttgtacagtcataccctccaaactctaagatgtatactcttacataccaaaacacaaagaaacaacaggaagtaagaacaaaactcaagaggtctgagtgacatcttgccttgcttcacaacttcagagtttgcattgctttaaaaacattggttataagtgagtgtggaaacagtgtgttcactatttttatgctgtggctgtgctgtgcaggagctgggcttttcgtgcattttagacagaattgaccttggttaatgcttgacttgggaactatgcagaaacatccaggaagtggtggtggctgatcctgaccgtcctcagttttgtgaagcaacagcctctgtgcctctttctctgcatgctctgttgacggtctagtcttgagagagaacctgctgctgtcccgtctgtcgtagccttcctagcaactcttaggcctgcatgctgtgttttcatgatctcccccaaagcggcactttgatgttttttcagagtcaaagtatcactgtggatatttatcccaaacaaaattgcaaactgatcaaatgttatgtcttttgataccaaatcaaaaacgattcttggtggctgatcaggttgtctcctaaaaatttgccttttgaacctatactgcctttatgagatgattatgaaagtagaaaatagcctgtgaaaaatggtacctttgctaaaaagaaaaaaaaattttttttgaaactaagagtctctgttgtccaggctggagtgcagtggcactatcttggctcactgcaacctctgcctcccaggttcaagtctcccgagtagctggaactgcaggtgcacgccaccacatgtggctaattttcatatttttagtagagatggggtttcaccatgttgcccaggctgttctcgaattcctgagctcaagcagtctgcccaccttggcttccgaaggggctgggattacaggcctgagccaccgcgcctggcctgctgtaagaaaatattaaacttaggatgggaaatgtgatctgaacaggattcctgtgaaggtacccagtgtaggtcttagtctcctctccagtgtacatttatggaggggcaagatttcaccattctgtgaagaactctgcgtgttgacgactgctcacgcctagggaataaatttcagagcatgcgtagatagtgccattttctacttaaaatactataatccattatttacttcggaaaataaaagcattaaggctgaaagttttgggttagtaatcttgatgttttaaaatgccttagcattccttcatttgttttgcttgccacgtggttttgctctgatttacacacctctgtgcatggctaatccactgtgccactcttggggctttattaactcttctctgccagtttttcccttagagaatatcatggccattctctaagatgataaatgggactaagagtaaatgcaggctgaaaaagcatttaacaggtcaaggatctgaagcttttaagaaggcaaaacaataaataagaaacccaaacagagtcttgaagcacacccatcgaaacccaagtttcagaatttgctgcagccttgctgccaaatcacagtaaaagctgaaaaggcttttgtggttagttacgtgtgatacaagaaatcgatgtgtctgagagaagtaggatttctctttttgagggggaaaaatacagcaaggggaaatgttttattaacaataaatatgcggcttaccatatctgtagggcacagatttggttagtagtattttgaaggcaggataaaggaagatcctaaaatctctgtgctgtgtagcttccattcgagctgcacatgttaaaaacattctaggatccacacagtttaaacaaggtggctggcttaggaaatgcttctccccattccttggcatccccacaaccctattctcctactttctcttatgtatctggactggcttttaaaagatatttagtgaaatttaattttctagggaaactccactttgtcaaaagtgtagtattcctcaaggatagctttgctggtcggcaaatctcagttgagtgtatttgtggtttaaaaaaaattctttctgaatagaaatacaaagagtgataatgtttaacattttattttttaaaaagctttacgctgtgtaaattgtgggttgacttcatgtttctaaactttgtcttttagaatgactctcttgggtaaattattagcagacactctcgtgttgacatgtccattttcctttccattaagctgtctccattgcagttctgttgatatggctttatatagttttcctgagcttttttttttttttttttttttttttgggaacaagatacctatgcaagctgaaaaactcttggctttttagtttgtatcacttccagaaacttttaaatgctacgtatagaagtggctttcttttagggttaggtaagatacttccttttttggaaatagttttgccatttggtctcgctgcctgatttgtgctttttcttcttcagcaggtagtgggaggctgtgtattgtattgccttttaccagacacccagaggggtcatgttggaaaatagcatcctcttagcaaaaacacaatcccttctctgagaataaattgccaagtctttccaggtcattgatggactctcaggtgctgcatttctgcacgtcggggaacaagggtgaagaacagagctagtccagcactgctccgtcctcccgcatttcttcttctgtagagtcttttgcaaactagagagtcttgcagagagttgttgggttttcccaggagatactgtatgcaaagaattgtcatgaagacataaaatcaagtcttggtgtaaaacttttaataaatttaaaggcatgtctctgtttttctcctcctctatggggattttcatgtggttagtaataaaactgtaggcagttgtatgtctagatttctatgtaatttgtttgtgttcgtatatgcacacctgtatacatgtgcacatgtattcaagaaagacctgcagtatgcttgaaaggattgaggtgcctagtttgtggtagtagctgaacagagtgggaggtcaaagttaagtcattgtgaggcaagggaacttgacttagccctttaagaattggtctgtccctgctaagccaaggctattagtgttttcttccctagctgtgttctgaaatggttcacctgacattcagctgggttgggggagaacctctttaaacatcagatcttattccggaggagtgtatccagccttctcacagcatatcctgttaaatatctgttcaaggttagcctaggcctggagtatggacagcatgaagccagatctaaaacagatcagttcatggataaatgatgaatttaataaaatttgaaaataaaccccacataactagtgctgctattgatcattcatatagccagcaggagtggtgagaggcttggtctgcctgaggtgtggagatgcttgtggcggggggcaaggtggacgagggctggggctgctcctggagcatctttacgcgggtggaggagctctgacacagtggcagtgtttgtaacactttccaaagggattaaaataattctgtagagttaaccctaggctagtgtggcttgatctgaaacagtcccagccagaaggtaagaactcctgtgttatgttgttagcatacaatttgctgaagttcacattttaaattttatatttaaaaaccaaaaagtagtactgatcattttggactgtttcaaagtgatattgtttttacttgttacaaacattggcttgcctgcatctaattgcactcacaatgggccggatgtggtggcttacacctgtaatcctagcactttgggaggctgaggcgggtggatcacctgaggtcagaagtttgacaccaacatggtgaaaccccgtctctactaaaaatacaagaattagccaggcttggtggtgggtgcctgtaatcccagcttctcgggaggctgagacaggagaatcacttgaacctgggaggaggaggttgcagtgagccaagattgtgtcattgcactccagcgagtgcagtgtaaatcccttaaggaaacagtgtgttgtggtaatcgtgatatcatagtaaataggttttgttcgttatttttttcttttacttccttttctaccagtgactagtcctaatgtgttctaacttttgaaaataaagtacaaattagatggatttaaacatacgggaagtaagacggaaattcattacttttaaaaaacaatttgttgtggataagatttagaaatggaaacacaataaactgtgtttccatgacacaggtatactaccaagttcttacaatgtacctttgaggtaacgaattttcatgtcatttggagtagggctgggccagtgagtcactcatctccttgttcattcattacgtgaatacctagtaaatgcccactaggcaccctggagtcatttgtgtagagtggcatctctatacaactgttcgactaactgtcggagacaccctaatcaccccagccacaaacaaatagaacattgtatgtgtgctgaatcccacaaaggccagacatgatgccatgagaccaagaaggaaaagaaataatgtggaaagggtttggggtggaaaggtggggaacctggaggcgggccacatggggccccagaagccatgttgagggttttgtcttcaccaaaggatcagtgggagattagtgtagaacattaaacagaggtggggtatgtgtcatatttccattaaaaaattcatcctggccacagtgtaaagaatagattagggaggaagccaatcaggaagcaattggagtaggcaatgcaaaaggcaaagtgaacttggactagtggtggagataagttgactgcagagagagtaggaagtaaaattggccaggcctgtgttgggggtgggcttgtgagcaggatatcaaagataatgtccaggattctggcttggatgacaactatggcaatgcccattactgagctaggagatgctggaggaagatcaggtggggactgtgagcatgagtttgatttttgcagatactgggtttgagacacttctgagtcaagcaggcatttggaaatgtggactggtgccgagaaggaattcccagcagtgacttggtttaggtggtcctggaaagtagaaacacacacgagataattctggggatggagcttaaagggacgtcagcgttcaagggccaggtagaggatcatgagctgtaaagggacccaggtggttccagcacagcgaggaaagcatgcgagtgtgatggccaggcttccagggagagaggagggttttaaggagaacaacgtgctaaaagccactaagaagccaagcagagtgagaaatgaagacctccactgggtcttgcaagaggggaggcctttgaggacctcacctgagagctgatgaatgaagtgatggctggaagcagctctggagagggaggaatactgtggggaggggaggaactgaagaagtagagaagcatggctgtgcacaggggaggtgggatggcagccagggaggagcagaggtggaatgtggatcttgttttccccaacagagatagaggggggctaaaagtccatggaagggactctgctgagagggaagggtggatccatgagacagaaggggagagctccagtaaggacccagaggtctgaggacaggccaaagcacagatggagggattagctttggatggtaagaggaaggacagatggccccttaaacatgacggtaatgcaaactgctctgttttttttttttcttttggcgtttgtgatgaactttgtatatgctttccctgtttgannnnnnnnnnnnnnnnnnnnttatatattaaacgggtcgtctcagatagcgtgaaatcaggccaccccccacaacaaataagaagcccgggggcgggtaacaagccctcaggatcagcgggcacccccccacaaaataaaaccggtcggaaccccataagccaacaaagacggaaactccttcaccaaagagcaccccaaaaaacaccggcgcccaccgccaaaagcacaagcacgcagtgaaccaaatagaggaacggaaagaggaaaggccacgcatagccccaatgaaaaaaaggcgacgaagggccaaaaggcaatgtggcccgcgcaccctataggacgttggcatgaaaacatggaacaacgcacccccagtctcgatccctcacccccccattagaaaaaggaaacaaccattctcctcacctgagggaaaagggcccctaaccccggaagaggccaggaaacattcccagagtccctcaggaggaggactagtgctgggctcctttcctcctgttctgctgcctctgagaggagccaggattgaatcgtagccttgtcctctgacctggagtctgggagtaactctcttatgacttttttagcctagtagaattgaacatgaacttcatgttttaagggatggttgcatttgtttgaatggtcacttctttttctatcagtattagctaatatagggagaaggaagtcatgcttctcaagtaaagcaacagtatctgtgtatccatttacttgattgagctttctactgaattacaggagttaaattatactttgttacactcttggtattacaaaatgatggccatgcctttattataaaatgacaccagttattctttcctggaggatgtgccttgtgtcactagccgcactaagcacttccccactagtggccccatgtggttgtgtgtcatcgctgactacctgttacaggtgaggaagctgggtggtgcagagacagaaagccggtggcccagtcaggagctcctaagtggcagagccctgtctcctgggttccttctcctgtctttcttgcctctcacttgaaataagagaggacatcagaactggcctgaatggggccctggtagggcaggaacaggacacctctgtggttttgttatgatgtcctgaggataaaggagtgaaaaaaaaatctttgaggaattgaagatttctttatgaaagatggctgaaactcctgacagcttttcaaattcatctttggagaaacttccgttttctctttcctgttccgaggcttaaagctgccctgaaatctacacatttatcaacagtctcttgtcaagactccagggagacaagaactcttatacattgctgttgagagtgtaaaacggtacaacctttatggaaggcaaattggcgttataaatgcgtgttacctttgacccagaaattctacttctaggaatttatcttaccaatacacctgcccacatacaaattgcagcattgtttttgatagtaatacgttagaaataacccacgtgttcttcagtgggagactggttaatacactaagatatatgcacaaaatggaatgctctgctgctgagagaaaccacaagtatgccctgcacccctgtgaatagatctccagtatattaggtggagaaggcaaggcaggcttcttttttgtaaagttaaggagggtaaataagactgcatgtttgcatctgcttgtatttgtgcagactgacactagaagggaaaccaagtaactgaaaaacacgatgattcaccggggtaggtggggaaacatctaggtcgggacaggtatgggagtgacacacctcagtgtacatctttgtatcatttttaaaagtctgtgcttgcattatgtatcaaaacttagtgctatctcctcaggtgcagggttctctggaactctgtctaggttggtctcttggatggcattcttggagacttgccggaaaaccaaacaaaaggtgtgagtgcatgcctcctggatagatgtctttttagtgtaacttagcacaccttgtacactgtcagggcgcctctcagatgagtcatcccggcagcccctgctccatgagtgtcttccccacagtcctgagtgcttctaaaatcatctacaccagtggaggcaaaactagatattttcttagtttgcagaaaggaatatttccagacaacatgaacttgttctcctttggtctccttttccttgtcattgttcaagtcacaaggtctgctgattaaatttccccttgggtttcaaaagaacttgcttgtttggttgttgtgttttgccttttaatttgagagttgaggcccccaggtgcatgtggtaaagaattcaaagggctaaatgggtgtgtgttgttcgttatttctttgaacctcttggcacttgaatggtgtcagtaatttcactaattatggttggcaaagaaactctgacacatggctttggagctgtgttgttcttacatcatatctcttgagttgaacctatgctctcttgatggatgaactcgtaattcaccaggtgcgtggatcgctgtgattaattgtttcaagctatcagttatttaactctctagtgccaaatgttcaggagaaaatgtaagtgcagtgtaatgtaaaatcaagccggcaactccagcaatttgctcttcaaactatagctctatcagttcccattcatttatacacttacactactcaatttgtcgttgttgttgttgttgttgttgtttttgagacagagtttcactcttgtcacccaggctggagtgcaatggcatggtctcggctcactgcaacctccacctcccgggttcaagtgattctcctgcctcagcctcctgagtacctggaattacaggcacccaccgccacacccagctaattttctgtatttttagtagagacagggtttcactatgttggcctggctggtctcgaactcctgacctggtgatccgcccgcctcggcctcccaaagtgctgggattacagccactgtgccctggcactactcaatttgtaataaatcagggtaagttatttttggtgccaagtcgattaattgaatataggttattttgcatcttagattccctctgacgactaaatcttataagcagaggtatgtgagcatgagaactgtgtcgggtggtcctgaagagattagtggattagaaggagatttggagatttttaaaaaagcctctggacagtgagttaaatggtgggttgacactctgtggtcgggactttttggagagtctataaagttctgctgtatttctcaagagctagagagagatgatactatgaccaaatttggtttgaatgtattataatgtactgagtatcactaatttgttgggaaatgactgttaaaaatacttactgacgcttaaaaatatcacctatagcattagtataagtagccaactgatttacatatatttcatgtgtgtgttgggagaggggtgtggattcgttaggccaaagatttcggtaatatatttggaagagataaatgaagataaagagataaattaccttttgaataattccaaaactaaaaatgcttcccttaatttttatttctgattttcttatttctatcagagaaatgtttctcatgtgacaaatataatgctttcatatttacttctgcatgcacaacttttaattaagtattaattgattaattttttagagacaggatcttgctgtgtcatccactttggagtgcagtggtgtagtcatagctcactgggacctcaaacacctgggttcaagggatcctcctttttcagcctcctgagtagctggaactacaggcataagccaccttgcccagcaaatttattattattattatttttgtagagatggaggtcttgctgtgttgcccaggctggtctcaaactcctggcctcaagtgatcctccttccccagcctcccaaagtgctgggattacaggcgtgagccaccacatgcagtccgtgtacactttcacaccttttaatttctttactcattaggtgcattctttagcaattatgtgtaaagtggaaatgagcgtgcaaatcgtcattttctattgacttgcactccagaattggaaaattggaaaactgtaggaaactggaaaattagaaaactgtaggatctaaaacaaatcgcttctatgacttataatattcacttgtagaactcactggcctttgtcagctttcagagtatgtgaacactttttgccatgtaagtagttagtccattggcaatggatatatgtaagttggtatcttcactgcaaacatttagttaattgcgtttattcttgagccattcttgctctacccttaggacttgattttcagtagctacagtggttattccagaagttgttagaattaagagccaggaggaggtactatgtaagctacatttagactccactggacactcacatattgcacgtggaatatcttaaaggggttgtgtgctgtggtcagggtgggaattatctcttttctttccatgagacctccactgtgcattatttaagggcctgtcaattgcccgttattcaagttttgttgttcttggaggacactattgcctatttctttccttgtttaaaaaatttcatttaggtaggcttagcatagttgcagtagaatttaataaatccttttttttttttacagaataaatctttttattacgtaaataccctttaatttgcctatttttaaaattcttgtttctgtgcttaccttgttgttagacagccaaggggatatgctgctctttttagtgccaaggtaaaaggtaaagctgtatcttaaatatttgtatttctctttggtcttggtgacccaaagtgatttgggtcattctgacatttaatcaagtttaaacaacatggctcttagaagtatgtttaccaggtaatctgagggctggttacctggtaacgcaattgagaaatttcatcaagactaattgattaatttattaagcacttattgtccagtttgcctttaattttcatttttctaagtttccattagctatcatggcctcacttgttatttcataatgaatggttacaaattgtttgtgtgtttttgtaattagaatgtaatagcaatcgtctaccagatgagctgacattgtaatgacatgaagtcagtaacaattatgccttacaggaaaattaattctgtaatcctatcatcccatattttgcctaagagattcgatttggctgctgctaggctgcttaggcaggtgacagcatggtgggacacttctcatttttctggttagactacttaaccataacattcatggtgccacctgaaaaaataattttatcgttttagacttttaaaatatttttaggctttttttttttttggcttaaaaaaagaatctgttctacttgggtattttgttctccttatttcttagtgaacaaagatatttgctcgacttctatcccagaaggaccatcctttcttcttccttttccttacctctaagggatatgaagctgtgagagggaattgcatatagcaataccattttgattccagtgaaagttcttacctttctcttttgtcattctcaacctcttacctgaagagtccattccctcagtatatagagcatctggaagtctaaggtgcaggcaggactgaaagagctgagaaaggcctcacatcaggtgacactggggcacctggctgtgctcccttgttggggggtcccttggcctgggcagttttgcgcttctccctgtttccctgtgccctgagactttgtgggtcacaggcaagggggctggcctccctgatcaagggcccttggcctaggagggcccctggatttatctagtccagcttctcgtcgtccaggtgcaaaactgatgctctgagatgtttagggatttgtccaagagcagagttggagccacagtccaaatcttctgagcctagtatggtattctgtcatccttggtttcattttgttctgttcataaaaattgcccaaaactgctgggcaaagtggctcatgcctgtaatcccagctcctcaggaggctgtggagggtggattgcttgaggccaggagttcaagcctagcctgggcaacattgggagaccctgtctcttaaagaaaataattgcctaaaactattcagggttaaaaatttgtctctaagcttaagaatttggaaaaactcagaaaagtagccacctataactccagcattctgagaacagttaagtgtattttcttctagttttttgtttgtttttgagacgggatcttactgtcacccaggttggagtgcaatggcgtgatcactactcactgcagcctctacctactcaggctcaggtgatcctcttcacctcagcctcccgagtagctgggactacaggtgtacaccaccatggccagctaatttttgtgttttttttgtagagacagggtttcatcatgttgcccaggctcatctcaaactcctggcctcaagtgatccacccacctcggcctcccaaagtcctgggattacaggcgtgagccatcatgcccggccttcttctagatgtttaaaacaaacacattttagtgtagttgagcctctgatcgttacatgtttatttcctagcatttaaaagcctttcagcgacatacactccttattagcttaattttttcttttaagagccgtgttcttgctctgtcacccaggctggggtgcagtggtaccatcgtaactcactgaagccttgagctcctggcttaagtgctcttcccaccttaaccttctgattaactaggattacaggtgtgcatcaccacgcccaggtaatttctaaaaaaaaaagttttttgtagaagtgatgcctcgccatgttgcccaggtgtctgtcttgaatgcctggcttcaagcgatcctctcccctcaactctcaaaaggctgtaaccctgattttaatggtagtgtaaagtgacatgggatgaaggaaccgtaacattcttaaagtttccccattgttgggcatttgcattggtcccagttttttataagtaaagaaggctgcagcaaactctgttgtactacttaatctttgtcctttatttcaaattatctccctacaatacgtcccttgaaataggatttctgtggaaaggtatcagtttaaagctcttgacccatatggccaagttgctttccaaacagcttacctgttgagactcggacctatgcttctaaagcctatgtgtgaaatgttcacattgtctttgggagaagcttcccacgaataagaaaaataagggaagaacaaataacataattgtttggatatatgctgtggtttgtgtggacgtctcccaccctttcccttccccagcccaagtcagtcttctgtataaacaacttacataatacagactcttcactgtttgtattatacatgtattttgtgagtctgtgtcagtatttgtttacacgggaattagggcatcaggctgtcttcctagggttcctctgtgcagacttgtagacagtatgggttctttgcgtgctgagttgaggtggccccaaacctttcagacagttgctcagatacctggcagttgctcatttacccttccagaccttcctgcctctatattagccaatgacaagcagatgctttccacaaaacattcgtgtgtgaactgttgacatttatgactgttttctgagcccacaccaggtcatttttctataaaatcagaactgtgagagctcagggcatgtggccatcctggataatgggtcctgctgtctggggagtcgttttcatcaaaattcacttttaaagaatagagtgtttattaacgaaaatatgtgagccttggctgggcactgtggctcctgcctgtaatcccagcactttgggaggccgaggcgggtggatcacaaggccaggagatcgagaccatcctaacgcggtgaaaccccgtctctactaaaaatacaaaaaaaaagttagctgggcgtggtggcgggcacctgtaatcccagctactctggacgctgaggcaggagaatggcatgaacccgggaggcggagcttgcagtgagcggagattgtgccacttgcactccagcctgggcgacagagcgagactccgtctcaaagaaaaaaaaaaaagaaagtatgtgagccttatcccccaaatgtacctgacatgtgaataatatggctcaaactaatgatgtgtataatattaaattgactttgttattataagtgatacataattcaattttagttaaaatgcattatttcaatcaatatcaaatattgcagaaggaaaacctaaaatagtagccaaagttactcagatgagataaagaatatgtttagggctggaaaatcatactttttttttttttttttgagatggagtcttgctgtgttgcccaggctggagtgcagtgacatgatcttggctcactgcaacctccgcctccagggttcaagcgattctcctgcctcagcctcccaagtagctaggactacaggcacgtgccaccacacctaatttgtttgtgtatttagtagagacagggtttcaccatgttagccaggatggtcttgatctcctgacctcgtgatcacctgcctcggcctcccaaagtgctgggattacaggtgtgagccattacgtccagccttttttttttttttaaataaagagggtctcaggctggcgtgcagtggcacgatctcggctcactgcagccttgacctcctctgctcaagcaatcctcccgcctgagccccccaaatagctgggaccacaagtatgcaccaccatacctggcttttttttttttttttttttttttgtattttttgtagagacggggtaattctatgttgcccaggcttgtctcgaactcctggcctcaagcgatccacctgccttggcttctcaaagtgctaggattacagatgtgagccactatgcctggccaataattatataaattttgatataaattcctgctcttcaaggagatgtgggttttttttcctcctgagagtatatttataaagttaattggattttatacaaaagaagcttttgactcatttcatttagcttttaatgttatcatctgggaggagatggtgaagaattctgttagccaaaccatggcgaattaatgtttcttacagatggttttattactttttatgatattatttggatcatgaaacaagtatcttggaaaatgtgagatacaaagatgtgagttgggaggtctctcttgtatgtgagttccttctataacagagaaaggatactttcagtttaagctgagatgctttttccttttcactcttgaaaagtctttgttgcaggaattttctgtgccctccctcctctgggacagatctgcttcttgatactgcagggctccagccttccttccagccagctcatttctcagggaagccttgttttcctttttcagaaaatttaaatgtatatttaacgcacaatttaactccctttcctgttgataatttttttcttcttcatattttgttattaataatagcttacagaatgggatcagtatcaggatcgggaggtaaccaggtctccaagttttccctttcgtttttcttttctgcttttaatgagccttaattaatccagggagctaggctgcagtatctgtggctctccctgatgttttctttctgcatttctgtcttggaggggaacctgaggatttggaagtagagggctctactagtgcttcctttttgtccttttctcattgtccaaaagagtcttaagcgatctccaggaaatcccctgctcctgccaggaatctgcctgtgagtatttgagtgagttgctgctttttaagtaccagttgagaagctgaaggttggtgttgtggttgtgataaactcccaacatgaaaactgaggaccaccagcgttttcagctcacctttgactcacgctggcagctccaggaacactgaacaggagtccccactgaacctttgctgcgttccgaagcagcacagccatggttaggcactgccaggcagctcttggaaaccacagggagggaagttttggttccttctttctgtctttgtttttgagaggaatgagcttggaataaaagaacgctagtaatgactgatttgcaggttaggtgtaaacattaaatcctcataacaggctaatgagaggtgggagaaattatccccattttacagatgaaggaacagaggctcctagagactaaagaacttgctactcaatgaggtcaggattcacacctaggttgacctgaggatagctgctgcagtgctcacccttcctaccttcccaagaaacaatacgcagagaatttcttttctaaatattgtgtgcctagaaggtgctttgtgttatcgaaacagatatatatgtgtatatctggtctctttaaaattctctttaataaaaacaaaaagtgatgctagtgtaaaataaaagatatatatagaaaattgtgtgtcctcgttaatcttctttaggaaagatatatgcatatatgcagtatagttttgggtttttataaaaatgagatcatgctattagtatagtgaatagcctctatatagtctttcgtaacatttttactttttctcggtgtatggatatcaatttaggtcagttgctgcggagtttgaaacgagttaaaatttcagcagttcacaaaatggatgattcatagtttagtcgagccatcatctgttgatggacagtcatgtggtttcttgttttttctttctctgtgtttcactaatgaaacaggattacagtaaattgactcgtgtatgtgtatacatccatctttgctggtactatagaaaagtgtattgctggctgggcatggtggctcatgcctgtaatcccggcaatttgggaggctgaagtgggtggatcacctgaggtgaggagtttgagaccagcctgaccaacatggcaaaaccctgtctctactaaaaatacaaaaattagctgggcgtggtggcagtggaggctgaggcaggagaattgcttgaacccaggaggcggaggttgcagtgagcctacatcgtgccactgcactccagcctgaatgacagagcaaaactccattgcaaaaaaaaaaaaaaaaaaaaaaaaaaaaaggcgttactgccttgttcctgatttaaaaaaaaaaatgggttttaacaaggaatatgttaagttttgggaaatatagtttatcatatttaaggtggggatactcattcatgttttaatttttatcggaagaggctgatgaattttatgaaatgcctttttggcatgatataattgtgagcttttgcttttatttggtggtgtaataaattacgttgattagatttcccaatattgaatcatctttgcattcctggaataagccctaatttgttatggtgtgataatctttggatatgttgctatttgatttgctaatatttttttaaaaattgtgactgtagcctacaaagccctacagataggggtctttagtttttttccttgtttgcattctatcaggtattgatattaggattatgttttttaaataatttaagaagaatttcaccctttcccagcatctagaagcatttacataatataggaaataacctgtttttttttttttttaagttagagtaaaattaactggaaaacttcataggcatcccctgtagtcccatcccagaacattttaaaacaaattttttagtttttcagaatatattatagttgttctgttcagcttttaagccttttctctggattttgatattttctacttgctgggaaagaatttatctacaatttgagtttatcgcacagttatttgtaatattgttatcatttctctggtaatcataaccctttctcattactaacacatatttttgctctttttttgcttttttcccccttaatcaagtttgttagaagtttatatattttattgtcttcaaaaaactaggtatattaattttatatttatcctgcttttaatttcatctcagtatttaatttttattcactttttccattcctttaagtttattaagttgaatgcctgtctcatttgctttttagtcttcttaaaataatggcatttaaggctatacattttctttgaaaattgcttttgttacgtatttttggttttagacagttgatctcctttttgttgttttctagatggtttgtaattaaaatatttatttgatctttgattctgacattacttagaagtatgtctgtccttgaatttttcttttgcttaccttttgatattgtttatatgatttatgaatgcagctctgaggtatctgagaggatttattaacgtttacttgcgtccaagtacatgattaagttttaattgctttgtggacattaaaaaattatgcccttggtaaaatgcaaaggttttattttctgtatttagtaaatcaaacttactgattgcattatagtcagatcttccaaattcatgtatgttttcagttgtcaaattgacagttaatgatgcaccttttataatttttttttttgagacagagtttcactctgtcgcccaggctgtgtagtgcagtggcgtgatcttggctcactgcagcctctgtctcctggattcaagtggttctcctgcctcagcctcctgagtagctgggattataggcacatgccactgcacctggctaattttcatatttttagtagagatgaggtctcactatattggccaggctggtctcaaactcctgacctcaaatgatctgcctgccttggcctcccaaagtgctgggattacaggtgtgagccaccacaccgggccccttttataatttttaaacttttcatatttccaagagaaatgcttagtgtatttatctgccgttttgcttgatgcatcaatatgtgtaatttttttatttttcagggattacatatttatcacatgtaatatccctctctgtccagtttaatgcttaatggccttgagttcttggtttgattttactattgccagctttgctttctttttacttgactttgcttggtatactcttgttcaattgtttgtttttaaatagagctggacttttaaaacccattgagacatttttgttctctaatagggacgttctgccttgtctttctttactgtgataatgcatacattttgctttattgctttcatcttattcaatggttgccatttattttactttctgttattctcaattcccatgttaattgaacaagtcctttgctaatttgaaaagtgtgttattttcaaagctaccggtgcctaacaatttgaaaatctgtatttttctcctgaaataggtaccagcattaaattactaattcttccaccagggtttgcatttccgcaatttctgccgttcccatgactttctctgtctcctggatgtgttctctgtcttttcactcatggattctagtagattcttattccttgctcttgggcgctcgcatttcttcttcttaatcctccagaatctgatactctagagcaacagatcttttctgttcaatttaaaattttaaagtgtttttttttttttaattcctgaaagtttttatactccaattgtgtctccacatatgctcttagactcctcttcccgtctagttctcctttcttggttcaattagttctgtttcagctggtgccacctgttgcagctgagcttggtcaccctccctcaggctcctgcgtcgtcctcagtgggtcatggtttttctttgcttgccgatggctgccctcagccgtcacacaagtcatgggttagtgtcactcaaggaatggcagaccagcagatggtaggtgataagccaggaaacagatactgtgccgctgagttgctctgttcccagtctcttccgacaacataaggcttgggaacagttccaccttccatggaagccccccttccctctggtttcacctgggacagcaggatgagcagggtgcagggccttcttccctgtggatggactctcagttacaatgaccatggagaactgtacccgctctctgttttggagatttgggagatcctgagggcctcagaaggccctcactctcatcccatgcactacctgtaagctcattagattactgtccttgttactttagagaggggactgtgagggaggcaggaccaagtatgtttattcaggccactgtcttccccataaagactatatttgtgtacatttttctttgctgtattgtgagaaggaggtagaaaaaagatgtgcatgtctgcatttggaaacagttctgagagtggtgctgcatcagcggggctggattgccctcaactataagaaagtgggatacttatataaaggaagcataatacagcatgtttctcttacaggaaggactgtttcttagagtcctcatcctctgtctccatcactcagtatagcaaatcatacattccatcaatgttaatgacatcaattgtatgcctgtaagtatgtacacacgcacaggggcagggggcacttcttcactccacagctggaaaacttgggacaaaatgcctagccagcttggcccaaatttgagggtattgccatctgtatctcagtgcaggtgtttctgtctgatgttcacagtctgtttatccagagtgccccagaaaggacagtagtgttaggttaaacctgtgtatgtctgttcttggttttaataacagtcctgtctttggaattatttagtgtgttctctcatttctcaggaagtcaggatgttagtgccgaagcacttctctgacttggtccgacattgaagtaccttcccctgcattacagaagaacggccccccagggggtctgtttgatgaacacatgtattattgcagtgagatactctagaaatagcttcatgtccttgcaaaattgccagcacaagtaaggacctggaaattgttgctatgcatgtatgtcagaagatttcttaaccaattctgtactgaataaaataaaatttattttcaagttttgtagggacctggggcaatatgtcagatagagttgaatattttcaaggcatttttagttcatggggcacatagttggcttaagatatctatgtgtatcaggactgaaaggtaaagtgcccgaacctgctaatgaaagaggtgtctgtgtggccatctgaggttcagccacaatgtgtcttgcagaattattttattttgctagtttttaatttctcaaacagttcagctgcctgtcccgtggtaccgtgagacttctaattcaagatgaccagtatttgcagacagagccactgcctttgctgccacattttgcttggttattgtgtgagaacaccatttttctctttttaaatgaattgtgtttctctttttaaattgagcatctgactgggcgcggtggctcacgcctgtaatcccagcactttgggaggccacggtgagtggatcacctgaggtcaggaatttgagaccatcctggccaacatggtgaaactcctgtctctacttaaaaaaaaaaaaaatggaaaaactagctgggcatggtggtgcacatctgtaatcccagccacttgggaggctgagggcaggagaatggcttgaacctgggatgcggaggtcatagtgagccaagactgtgtcattgcactccagcctgagcaacagagagagactgcctcaaaaaaaaaaaaatccgtttacatagtgataaataaagtaattactatagtggtggcattctgcctaagtcatcttgaaaactgaatgcaaaatctttttaatagctccataatggtctcttgaagtgttacagatttttataacgatagctgtaatacaagtgcctttatttactgtgagacttgaacattttgaccatttacatgggtacttgtgtgtctccagctgagctgagtgcatgtcgctgcggcattgcaggcgtgtgtgcatgttggctcttgcaacggggcgtctgccaggggttgtctcgggcaggagaaggaggccagactggcaccacttgtagtgattggaatgtgtctagtccagctcttcagttccatgtaggaggttttaggatggagattgtgttttgggaactccaagtcactgtccaatttggagagtattatgtaagaaggcttatgttttctgattacccatccttcgatacagaccaaataataccacagtgataaaaatgggaaaggagctgtcgctcagctcttcttggccgtgttgtttgcttttcgatgtctaatttatgaaagcatttcaaagtgacatatatactgaacagcttcgtcttgccaaatgtaaaataaactggagatgagtttagcacagagctttgtagattgttgtcctcttggtagagtcggggcctaaacaccacctggcctctgtgccagtggacaggtgacctgcctgtcctactgctggtctctgcagctctctgtcttgggcaaccctggctctgagttccagagtgttctccagtaggagagtctgcaggggcactgtggagcacctgggtatgtgcacatctgttgttggctggcgttgtctctgatggcttggggtgtcacagagacatgacagtactgtcactgcatacctctcaagcttttgctgagtcctacatgagttgcaggggcagagagggagggagaaaacaatgcctagccacactgagaaaggggaaagtgctacagagtcctggaaggaagcgaggatggacatggacggggaagcattcataccaggcaggaaaagtgacttcatggaccagtcacagaggacagggccagggatcaaaccttccgtaatttgcctccacagtttgtctgagactggctacctggttgagtctgccagagccctgtgtgcaggtactaccactcactgtcacctccaggcaggaaaggccatgtgaatgcatgcatctttgcaggaacttgcccctttccactgaggtttgaggcagactccaaccacatttccatccagtggcttagtggtcttacccgtgagcttgaactgttgtccctgccaggacagtctttgcctctgtaagtatctccatattcctccatcctttcaggtcccattcagtccctaggtcctccatgatggaatattggttgatgcacttattccacaaacatttgttggccacctttcaagtgccagacaacccttctaggtatggaggggtacagtgatgagcaagccactgtttctggctgcagagggctcactgtttagtgggagaaacagacaaatcatacatcttaactacactgcccttgattgctctttacctgttatatcagtcgatcttgcctgcctagcatttgttccctgtttgggggcctgtatgatgttcgtttggatacctcagggtacattttcccatctttgtgatgatgtagctcacttggtctgaatgatatgtaatcctgcacatgtagagtgaccattatatttgcataaatagcattggaggaatatataagaaatgaataaaagttgttatatcatttgatttttcttttcttttcttttctttttttttttttttttgagatggagtctggctctgctgcccaggctggagtgcactggcacgcgcatagcccatcgcagcctcaaactcctgggctcaagtgatcgcctgcctcagacttcattttgatttgtgaacctcgtgattctattacttgttccacaaaaaattttaaatgaaaaagtatttcaaaaatacatatattccggccaggcatagtagctcatgcctctaatcccatcactttgggaggccaaggcagacagatcacctgaggtcaggagtttcagaccagcctggccaacatggtgaaaccccgtctctactgaaaatacaaaagttagctgggcgtggtggcacgtgcctgtaatcccagttactcgggagactgaggcaggagaattgcttgaacccgggaggtggaggttgcagtgaaccgagattgcatcattatgctccagcctgggcagtgagtgaaactctgtctccaaacaaaacaaaactaaaacaaaaacaaaaacaaaacaggctgggcacggtggctcatgtctgtaatcccagcactttaggaggccgaggcgggccgatcacaaggtcaagagatcaagaccatcctggccaacatggtgaaaccccatctctactaaaaatacaaaaattagctgggtgtggtggcaggtgcctgtagtcccagctactcaggaggctgacgcaggagaattgcttgaacctgggaggcggaagttgcagtgagctgaggtcgcaccactgcactccagcctggcgacagagctaggttccatctcaaaaaaaaaaaaaaaaaaaattcctccacaacatatattccaatgtttagtttttctgttacagagatcacatgtactctaacttgtcaactaaatttaaaaggaaaagacaactttgagagaaaattaaaaccaatgcagtgtgtgtaaatgccattttgataagctcttatttcatgttgacatattctatggtgctcgtcttacataacctagttagggaaatgttttgttccagtctggctttgtttttcttcatgtgtttaggtccttccactttccttttgttaatttttggtgttgtacttcaggaaatgaattgagggttgcaaatgacctggagggccttagtttgtttgcttgtttgattttagcaacagtcaccgtggtacacctgacgtggctgggactcctgattttttttttttttctttttgagaacaaagaatgtgtccttgtcttggcatggactgggtagccttgttcacctccccacccatctctccttattggtgaggcattgtaaaccgtgttaacaggtagcatccacagaaccctggaaaggttgtgaagtccctttggaagcctaagggttttgatctcatccaggttgtaatcttaaattctggtacaaattcccttgttacaactgggttaagtggttttaacctcttttgtgccttcattttgaatgcttagactggaaagtcgttcagagactcctgaccgaataaagcctacttccaaatgagtgggttgtccaggtgtgcttgtagatgtcacatacttctaacaaggctctgcagctgcgatgtcaccttgcccagcgtgacctcattagcatgtatgtggctttcagtggccatgtactttgcttctagagctttctttcccattctgggttcttaggagggggctgtgctttgtgtgtggccaggcagaagtccatgttttagcttttcaattctcttgaagaaaacaaatgttgttgataagaacacttgtcatggcatccgatttgttcttgtgagggctgtattagcaataaatagacatttagtttgcatatttaacacctcatcttctttcagcccacacgtcttcactacaggattagcttttcattacttagtagagcttttaattacctgaagctttcgtgtctttactgggatataacttttctccttattaaccagaaaaagtcacagaaaatcttgtaatttataatggaatggagtaatattcacaaacaggctttggcaggattttttttgttattgtgttttttgtttttgtttttttgttacactagttttatcacaagacaagaaagaggggaacttttagaaataaaaattatgtgctaaaataattaaccttcctgagtaacacacacagaatgttggtatagtgtttgcaccagaggaattacatatggaagaatgctgggatcttttaccaaataagggaaagtagagttcattacaaatagaggcttctagcacagaaaagaggacattttataagtactgtgaagcattttcagagataattaaataatagaaaatattaaaccaatttaaacaatttgtagtttttttctaataaccagtaagttcttcgtcttcgaataattcttttatactgttctatttccagctccactgagtgcccctgtgttttcagagaaaacaggagtctgttttggacttcctctttggtatatatggtgggagatttgtttaaaaaatttttttatagaggtaaaattcatatgacataaaattgtccatttaaaggtgaacaactcagtgacatctagtatattcatactgttgtgcaattgccatctctatctagttccaaaatacatttgtcatgccgcaaggaaagcctgtaccccttaagcagttaatccccattcccctttccgctcagctcctggcaaccaccagtctgcattctgtttctatggattcacctattttgcatagtgcatataaatgcagttatataatatgtgaccttttgtgtctggcttctttcacttagcataatatttttaaggttcatccatgttgtaatgtatcagtacttcatccctttttatgggtgaataatagtccattgtatccagttgtatccagaagatttgcttttcattgcctaacttcagggcttcagacacctcaatctttgttctgagatggatgtaaacttaatgtatatctctctctctcacccaatgatcatgccaacaccttttttttttttttttttttttttgagacagtctcgctgtgttgcccaggctggggtgcagtcttggttcactgcaacctctgcctcccaggttcaagtgattcttgtgcctcagcctcccaagcagctggggccacaggtgtgagccaccacacctggctaatttttttttcttttctcttttttgtttttgtagagatggagtgttgccatgttggccaggctcgtctcgaactcctggcatcaagtgatctgcccgcttcagcctcccaaagtgctgggattacagacataagccaccttgcctggccatgccaacaataattatttagaagtatgttgagaatacatcccaataatagaagtgaaagctctttaaaaagaaaaatattcaaaacttaccagctgatcttatgtttcatttagaatggctgcattctttgcagtaccctagggttgtagaaattctcccccatgattgcacaacccactccttctcagccagtgtgcacctggagtcagctgtgtttggccttaaggtgtccatggtccagcagggagagggcagatgggtcagtgttgtcctgctagtgatgagtatcccatggtgggcatgctgatgccacgcaagggagagggtgtctggttctgtgcagtggcagtggtgcaaccccttaccaaggtaccgtggggacctgggttagggcaggaggaggaaggtgttctctacagactgcagggcttggaggcagcctgtcatggggaagggtgtggatgaagggtgagccgggaccccaggcaggtacggagcagttcaaggccgtcaagtgtgcttcattcttcagtcattagggtgtctctgaaaggtttttcattgaatcagaattcccctaattcacgaattctaaagcttaagtaaattcagtaataataaactgtcaattatccaagcgatgaatataaatccataaggtttttcaaatccccagaaatccctttcatctcccacctggttttgctgagcgcctgtctcttctgtctcttttctgattcccacctttcacttttcctccatttttcgcttaatggatttatactttaaagtaggtattctgaaaattccaattttatgaatggtgtgacggtgagaactttgattcattgaaagataaaaataatcattacattttatactgcaagggtcatccttaatattcttcgtatttttaatatagctgcatgatttgagtagttgagttggggattggataatgtatttattgattgattaactctctgggggtccatacatacccctctttatatccctgtggtccctttttagtccttttgtaaaaacttgataatgttaacctctgccaaagttgatgcggtagttgtgagtggtgggacgcaagcgtgttgatttattcttggagacagcagaaacagcaccaccttcaactgttttgtcatgatcatcttgtaaccataattctgtgctaagtcagaattaatgttattttgttaattcaggttattgtgaaaatctccacaggaggttatttaagcaagtcacaaattgatgattctgtttgtagaaaaactccagctcatccagccagccacattattccagggctgcatggtgtcagcgtagggaccaggctcggtgtagagaccaagggtgcctttccccttcctttccgcccgttaattgcctactcgcccagtggtaccttctgaacttttagaaatccagataggatttccacatggttcattagaattcatttatttttttccatctgtatttctttttgttgtactccctagatcattatttttagttactttttacatgcattggttaggtttttcatgtaatctctcagtaagcgtactgggggatgagtgacctcagtatttaaatttttcataggtgggatgaaatgtcttttctgagtgtgagtatttctgttccattcttcttttccaggcaggctctcattctgtgctgcagtttggattcagggagcactgacccttctgtcaggttgctcctgctatgaaggatggaagggcattttgatacatgaggcataactgtaattatccggtggggcttggtttgtgctgttttccacctcttcgtcatattttggaaaactgaggccaaaagcaaagttcattttcccctttaaaagcttctttaaaaaaatgatgaaagagctttatcaatgttttgaataacccagaaaatatttcttattgttgataatctgcagtttgcaagtgcagcgaatcttgtaggtagatttaccttgagttttttgaaacggtagaattaatatattaaaacatatggtttttagttaaaataggatgttaaaggaatagagcgcacgaacaaagaactttccacttgaacccatgttgtttcatctgacagtgggtatggtgtccctggcaggatagggcttccacctcctgctggtgccggtaggacagggaagaggtggggaacactgtgtctccatctcccaagcatcttacctcccaagtcagatccctggcattgtttgcatacttgcgtgtttgtgtgtggggtgatgttttcctgagaatgtggcaaaataatagaaggtcccagggttcctcagtctgcagaccatagctgagtggtgtgtgcctctagccatgaggtgaagcataggtgaaattcagatccataggaagacagacagactttgcaagttagtaagctaacttgctagaggaaacggtagactcctgtgctggctgccaactaaaaagcctttctccacagttctgttctcatgtacaccctcaggaccttggatgagcttgtgtgttcaggaaattgggcaccgagattttttttgtatctttgattttagttgatatgtagtccttccaaggaaagtattcgttggatgccctttctacactttggcattgtgcaagaggtatcaaattttaaagtaaaagtgcacaacctggccaggcgcggtggcttacgcctataatcccagtactttgggaggctgaggcgggtggatcatgctgtcaggagatcgagaccatcctggccaacgtggtgaaaccccatctttactaaaaatacaaaaactagctgggcgtggtggtgcgtgcctataatttcagctacttgggaggctgaggcaggagaatcactttaaccagagagttggaggttgcagggagccgagatcgcaccactgcactccagcctgggtgacaaagcgagactccatctcaaaaaaaaaaaaaaaatgcccacaactgggcatggtggctcatgcctgtaatcccagcactttgggaggctgaggcgggcagatcacgaggtcaggagatcgagaccatcctggctaacacggtgaaaccccgtctctactaaaaatacaaaaaaaaaaaaaaaaaaaaaaagccgggcgcggtgccgggcgcctgtagtcccagctactcgggaggctgaggcaggagaatggcgtgagcccaggaggcggaggttgcagtgagcggagatcacaccactgcactccaacctgggtgacagagtgagattccgtctcaaaaaacaacaacaacaacaacaacaacaaaacctcacaaccctggtctcccagagcttccatattaataaatctagacaatgtgaaatgcaaatccacttaatatttgatgcaaaaaaaatttatttgacctgttattttaactctttgacataaaatctctaaatcaaaataatcagcaacagttttaagtgtataaatatgtatttctttcagtgcttgaacatttttagacaggaagattcttgatcttctttgtaagcaaatagcatcaaagagtaacatttctgtacctttgtggtatgtaccttgtggctaatttgtccatgaagggataggcattgtgttttgttgcttaagtcgcttaaggcctttaaagcatttccaaactcacctatttttgctctaaggggtataaggtgttaaaaaatgaatggaagttaactcattctcaccttgtctgctaacttccttttgttctttttctgtaagaactcataaagctgtatgcatcagctgctcccaggggccttctaaggcctcagtccaacaacagtgctacaggtgaggaaaggaaagaaggcactatgtcatcatgtcattcttttagacttggtaagaagtatattcaagcagatcagatgctctcagaatcacagcgtgttgtactgctagtaattaaaactgaagtccacgttgaataagaaataattttttattgattgctggcatttgtgagaaagggtttaattagaccaggatatggaggggacttatcgacagttccgttgtacattgttgacatggttattttctgtatctcattttgcctgggaatttgtcattctcttctattttcttatcagtagcactgcttttacacttattagccctagctgtttgtcttgcttatttaaacttgtacatggcacatgctcaaagatttttccaggcaaaatttctttaaagcaggatttgagattttccatccccttccgtctgctggattattccggtgagtgttaatctcccgcctttgtcttagcctctctgtggtcttcggttgcttccttgttctctgtagatctcctgagttggccattagctgtcaacagtcagcacttgctgcctctcaagtctcttcccctcctggctctgccctggttttgctctctgacggggatctaaattgggattctttccagtgtggaatcctgggtgtccaccatgtcactctgacttccagatgataatgagtgtgaccatgggctgaatgaatgtctctctgctgggattaaaagttagaggaaggcaaaaacagacattgcgtgttctcacgtatacgtgggagcaaaaaaagttgatctcttggaggtagagagtagagtgatggttaccagagactgggaaagggggcgatgaagaggggtagagaatgagtacaaacattcagttagatagagggaatacattctaatagggtgactatcgttaacagtaatttactgtatatttccaaatagctagaaggttagaaatgttcccaacacatagaaaggatacatgtttgaaatgatggatatcctaattattctgatcattatacattgcatacatgtttcaaaatatcatattaaccccataaatatgtacaaatatcacacatcaataaaaaataaaggggaagacataggtgtaggcatagatttttaagctgagaaccttttgacagggaagaccagggatggttttagggtgtggggaatctgtgtaagttggccgttagctgtcaacaggcaacaatcactgtctctcaggtccctcccgctcccggccgtgtcctggttctacttgccggcagggatctaagttggaattcctttccaacatggaatcctgagtgtccaccatgtcaaaattgtgtcaaaattcgtctgtatgcatttttcttggtagaagggtccccaaaagtcaccacattctcagagacttctgatccctaaaactttagatcaacagtcaataaaaaggtcccagttgtgtcttagtccccatggcagtacttttgaacatttaaaggtggagaattgctactgaggactttgttctgtggatgaaacttcgaatgaggattgttggtgagagttggattgttgttgtatgaggaagtgcaccttggaatctaatggggtcttcacggagggggagtcagttgtggcactgtttgtgtattccattcatcattcatccctccatccaagcacccacgtggagctcagaaagatgactaacacataccccctgctgctcctgtttttctaaggtgtgctgggaccatttacatttagttctttggagaacacaactacttaggatttttgttgttgttgttgttttcctgtacattgtcttcctatctcccttctggtacccattccaccctctctccccttcctcactgccgtttcataggggttctcagattcctgtgaataaagcaaaccgatgtgcagatatgtgtgcttacacatgtggacgtatttgaggaggtaagagggacctgcacaaggctttagtgagtaagcagagaagttatttatatatagtgagacccagtaaacggcgatgtcgcaggtgaggcagttgatctggtcagaatatgcctccagagacatcactggtgaggcctgcatgcatgttgaaaagagtgtatcttacatctaggcttgggtttccccctgcagctcacttatgaataacaacgtatgcaagagatttgaacattttcatgttcaaatgaaacatgaaaagggaaaaaaatttaaggttacggttaagtttggattgtttgcttattggtttggttattggcaattgctacaaagtccagggtgttctttatcagcagcatgcttatcaagttactgacgttcaagctgagtttccttccctccctccttccttcttctccactgacattttttttttttaaataggtagggaggcatttaatcttgtagcagcatgagagtagcttaaatgtccctcctctagcagtatgtttatagcagcgtaggtaaggaaagcccagcttgcacagctgagctctaaagtgcatacatcccttaagttctcatacacacactggccagtgagacccccaaactgcgaacagagaattctaattgaagtaaaagcatgaagtttttctttattgaccatgtagcaactgtggaatcatttgaaaatttctgaaaacatgaaacaggtgtttataaggagttttctgacttaacaaaattggtgaaataccaactttactaaaaactactaattcataattttttgattaataatttctagtctggaaaagaggaattttttgaaaatcactgatatttttgatatactgttgttttcaaattgagttctcatagtgtggtcggctctgttctatggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcatagctcactgaagcctcgaactcctgggctcaaacagtcctcctccctcagcctctctagcagctagaactgtatatgtacaccaccacgcccagctaatttttttttttaacttttttttacttttgaagaggtgagattataggcactagccactgtgcccagccaaaaggtcactttttttttttccttgttggggaggaatcaataacaggaacaccagtcatgatttggtgttttttccagggcagacaaataaagatgatattacgatgtttgttatcacagaatatgtttgcttttgataggggttgggtgctgaagggtaagtggttagaatcattctttttctaagggtacagtcattaatactccttgattcaaatcactatttaagttataaatacatggatttattttctaacctcaaaattatagcatcttaccacatatttgcatgcctctcttgagttaactactggtgatgattcttagctcatctgtggccaagtatagataagagaattagaaagttgtttccagcgtgtgaacttttatgattttcttccttggttactgtactcagttcttttttgttttgtttctatacaagatgagtagctggtggctcagatgacccccgtgctgcatgtacagtcccatccagagagtgttgggggctgtgtaaacctcgaggctcagagtggctgccattttcctaaaagagaagtatggctgctgttggcctcaatgttcagctttacaaaaattcccgtaattaatgaaggtcaaggcatctgcaaacattaatggggtcacaagggacaaatcagttccttgaggggaagttaaaatgctagattgcttaccgctccagacaaggcattctcaagaagtatgtgcagtttcagcacaaggattaacacggagcattacttgagccatggggtgccttgggggacatggatcagcaaccatttccttttgctcacagcgcccagattttgttctggggaccactcttatctgcactgcatagcagccacacattttgagtgaaattaaccccaactagcattcgagcgtcctcccctcccccaaaagatggactgtaccccacactgtaatcagcagggaggcatttcctggccacagttcaggttggtcccttagaacgctgctcagaactgtggtttggtggctctgggaagcagtgctctctctgagtgtgaataaggatccacatagctccagtaggtgtctgacgacatcttgtgatccggggggaagccagcctaaggacaaagccattgtggggtgagagacaggattggcacaatcactgacaaccgcagtagtagcccagaataaactgtgcctgaaacctaccctatttttgtattttttccagttttaaggaaataaatcccctttattgtatactcagtttgaatcaattatttttatctctttgggattggtttttggttaatctcagcaattcagaaatagctgaagaactatgctgtgggtttagacatcatgccgtgacaaaaagaagaggatcttagaagcgggggacattcactgaagctttatgagcctttcctgaatcccttcaaatcagatcaagttctctctctcctgtgcttagaaatgctgcctgttaagtcacgttggctacagcacccatctcagatcccttgtgattcagttgtaaagtagattcttctggtctgaattagaggccaaaacacaagacagatcaaaaatggggaacatattgcaaatttccccacaaaagactgaaggatgtgtttaccattgattgcacagggactgcagtgtctatgcttttaggcatggaaaatgcagggtttgactatcgagtttagattttaaagttgaggattgtttctttaagaagaaatatagaatattattcagtcctaaaaaggaaggacattctgacacatgcaacagcgtgaatgaaccttgaggacattatgccaggtgaaatcagccagtcacaaaaggacaaatactctatgtgatttcatttagatgaggttccctggagtagtcgcattcagagacagaaaacagaatgatggctgcggtggtgggggggtggggggtggtttggggaagggagtggagtgatggtttcacttttgcaagatggaaaaagttctggaggtggctggcggtgatgttgtacaacagtgtgaacttacttaacattgctgcactctatacttaaaaatggttaaaacggtacattttgttatggatattttcccacaattaaatttaaaaggaagatgagtagtactcgactcattattggatattacatcagggaactggaggtagggtctcacttactagttacgtagctcaggaacctggaaccagactccttctccagctgggcagtcccaggtttgagtcctggctccactggaggttgtctgacttggaggttaataataacctgccttagtcccagagtccttagagggaaaataggttataatacctgagtccatgtgtatcaagccattgctggttccaggcccctggagcactcagaaatggatgacccccagctgggtcaggccaagtcctccctgctgtagcaagcgggaccattgcctcgttccccccacctccacatggaaggtgccttttgtgtcctgccccatctctgttttaacagtcacaagactgtaggcagatctaaacttgtttgcacattattatcacctggggagctttgacgattccaaagccaggctgccacccccacctctagaccaactgaatcaccatttccaggggtgggactgggcatccgtgttttcgaggcttctgggtgagtaccttgtgcaaacaagttcagggaccgttgccctagacactgttcttcccctcatgtctcaacctgggcctcctaccactgccaccaccacagctatgccacctgggatgtgtcccaagcccccacttgtcggggaagcagctggggaggggtctttggccacctctgcagctataaggatcagagcaacacctggcttctgtgcctgtggcccctgctggtgctgggtccctggtccgcactgaaggatccaggcagagtacagtgggtctcccaggtcagaatcccctgggttgcttgttaaagctcacagggctgggccccaccccagggtttccgattcagcaggtctcgggctggttggatgatgagaatttgcatttctgtcaagttcccatgtgatcctttttggggtctgggaccacactttgagaaccactggtctattaaacaaatctttgcaaattagggaggtgtgttgtgggaggaagagactgatagttgaaagaatatttgcctaaatacagtgcctagtatttgccaagtacgcagccttctttctggctttaatcatacagactttctcaatcacatgtaattgcacatcctttaagcagcttttgactgactttggttttctcttttgtggtgattttccttaaactcccgaagggagggtggaaggggcaagagaaatttttatttatttattttaatttaattattttttattatttatttttttattttttttttgagatggagtcttactctgtcgcccaggctggagtgcagtggtgtgatctcaggtcactgcaacctccgcctcccgggttccagcaattctcctgcctcggccttctgagtaacagggtctatgggcatgtgccaccatgccgggctaattttttgtattggtagtggagatggggttttgccatgttggccagactggtcttgaactcctgacctcagatgatccacgcgccttggcctcccaaagtgctgggattacaggtgtgagccactgcgcccagccagattttatttctttaaaaaagaaacttactagttatcaggacacttgtgttcttggtacttgattttgtcagcattatttttaagagcctcttccctccttccccctacctccctgttgagcccaggctctgaaataacataggtgcatgtgaagttcccctacctgccattaccagacattggtgctgggcggccctcacctccacctcctctcacctgaggccacagcggtgtgcaaggatgtggtctgtcttgagtgtgttttcaaagcagctgtttggtctgtgccttggatgtttttccacagataagcccaaaagagaaccacatcttaaaacgcccgtgaccttgaatggtctttccggaggggcggctggatttgtgctctcatcgtctcaggtatgtgtcaagccactgttgtttcagagctggacacaggtgcttaggaaaattcctcactgaagggttttcaggatttacaagttcttgctgtttttgtgaccttgtgtggtttctggtttcacagaaggctttgtttcttggttcttgttgctgctttcagccttggcctgtaatcactgggcgccagggagggctgcggtctgtttcccggggtgtgctcagataccgtgtcagttcacatgtgttgctgcagcggcagggggccaggcaggaggggcgggtgtcctgaagcacgctcaatttgctgatcagggccttcacttggattttgcacttgccgcagtggagacattcctcgtagctactcagtgtggtttgttttaagtgggccatccgttaattcatgtgacctggaacttggttaatgtacttgccaaggttaaagttgagacgctgtttgttaaacctttcaaagagggaagaaggttgccttgaattcagttccagggtttgggagtctgagagggaggtggtgaggggcccggggaggccctgagaaacaaaatgctggttaaggacacagtctgctcaccgacctcggaagtctctagacgtctaaagaagtccaagcaaggaatgatgaccgaagaggaacctcaagggtgcaggcggctctgggatctcagcacatctcagtgatggaatgagctgccggggaatgacccctgtgggggctgtccaaagtcagagcagacacaaacgtagctctccaggccccataccttggtgggcaagagggcagcaagtgcatcctcacagttgatggggagagcagcatttcagcctgcagaaaagagaaccacacagatgtaagatgaggtctgcactcacttgcctggtcatgcagagacggagctgggagcagctgcatgacttttcagagaagtggcacacgtttactgtaagggtcccaaatgtagaccactgcagatggtaaggtctagatggagggaccaatagtagggaagtaggggagaagaaagtaaaaccttacagtataaagacccatagatgctcttttgtttttgatgtgtgtacgggggttagatatttattgagcacctactgcatgacagagtgttcagcaatgacaatgcagagcttaataagaacaggttctagactaatcttttagggggtgaggatagaacagaaataggtaattatgtcctgagaacatgagagagtgttggtggacagaacggcgatgtatccccaagggcaactgaagccttcacagaagatgcaaagcctgtacgtggtcctcggagtcatgccacatggtgactggttatcttagtcgtaggaaaactgagaagctttgaggcatgttctatctgtctttgtgggcatcatcttcattatttgaacaattcagagtgcttgatgccttttgcttcgttctcacaatccttgacactaagctgtgggcttgggttatagtcactcattctgttattcatgtcattttgcctatccttccacttcacagatgagaagactgagacccagagagggtcatggttttcattagccaaatggtgcagaaacccagtggtcacagtggctctctagctctttgtcacccacagggcccttgataagagtacggtctttctccaggggagcagggttgaggagtgggggcagccctggcctgggtggccatatcctgatttcccctcccttggcccatagctctctatcttgggtgaggtgagaaagtaaggctgctccttgactgtggtcccttttgtgtctgtcctgcactgggccaccttcccaggggccttgtgtcagcctggtagtggtgctagtggccttgaagtgagagtgggtggatcacacatggcagatctctggcagtgaccttttctgtggatttccggtgactgatgatagcctctttggaagtcagcatatgcatagctctctgtcttttgaaaacaatggaaaaacccaccaccagccccaaaaccagctgtctttcttcttatgaatagatatccatgaaaagcagaagagtagtttcttgtaagtactctgggagtgcataatacattttaaataagattaaaaattatgttttattcttactagcatcactgtcagataattgagcgtgagagcattcagtgctgtgtgcttggtacgaagtagtaacatcaattcagtgttcagtacatccactttgttccagaacaatgtattcaaggtcggtgtattttggctgtgccacagagttctggaaattcccaagagaataagttttcacctgttatataatccagcacaagtgactgtgtagcagcaacctcatgtttcatgatgactttaaaatgcaattgattctaaaatttagcttttaaaaatttcgacttcagattttctctgaaggtttaaggtaggcttctcctttattaattttttcaagaaatatttaagaacactgctctgtgctatgtaccattctaagcactttacagatactaattcatttaatcctcagcctggttaggtaagtactgctattcccaccgtacagatgaggaaacagcctcagaggagttaaaacaagttgctcaggttacaccgtcagcggtttggactacttcagtttcagataatcactgtgaaattttactgttttgagctacacgtttcaaaatcttttctgatgcggaactatcattaaatcatataatccgcttctctggagtcagaggttgacaacacattagcacttgactcgagcctctccctggaggaggacattccgtctgcggggagccgagtccgaggctggagcaactctggaaccacagccctccagtagagggcacacgagagcaggctatctgtggagatatcctgttggcacaggggtgaagatgacagaggcgaacccaagcaaagagagttaattagcagagtttgccctccaggctcggagggcaagtcagcctggggacctggagttagttcccttttcagctgtgaccattgaagacattcatcaagttctctggctccgggatgtcagctgtggtagtgacttgcatgggaggttatccgacatacctcacacactttaactccacctcttcagagtttgtggccaagaatggagccaggtggctattttttttttttaaatttatgtaataacaaacattcgcatttattgaaaacttaaagtataataaaaaaataaataaaataaaaaaagaaaaaagaaaacttattcctgtgtcaggcacttttctaagtgctttgcagtgtattgtctcatttaatagttgtttaaattaacagagtaggccgggtgtggtggctcacatctgtaatcccagtactttgggaggctgaggcgggtggatcacctgaggttgagagttcaagaccagcctgacaaacatggagaaacctcatctctactaaaaatacaaaattagccacagtggtggcgcatgcctgtaatcccagctactcaggaggctgaggcaggagaatcgcttgaacccgggaggtggaggttgtggagagccaagattgcatcattgcactccagcttgggcaaaaagaatgaaactctgtctcaaaaaaaaaaaaaaaaaaaaaaaagagagtaaataaaattgtaaggtgaatatgttatctacttgatggaattttttaaactaccttgaaaagttttatagtttcctatttacagatgaaattaacatactaattataaatcatgcctcactattcactttaggcagtctatctccttaaggatctccttacggtttagatagataagtgaattgcttaatgtttttggaagtaataaaactgcatttctttttaattaaacaatccagataacaagaagtaattctaataggaaacttgtaggatgtatttacagaaaatctacacaatcttactgaacaatgtagaaaagaagatttaccagcctgggcaacatggcaagctttgtctcttaaaaaacaaaacaaaacaaaatttagccgggagtcgtggcatacaattgtcatgtccacttctcaggaggctgaggtgggaggactacttgagcccaggaggtcaagactacagtgagccacatttgtgccgctgtactccagcctggatgacagagcgagaccctgtttcaaaataaagaaaaagagatttaaatgaagcgaaatgccattttctctaggtgagaaactggaatattatcaatgtcacttcttcccaaattgatttataatttaaaaacaatttcagtacttctgcagcttgtttggagcttgataaaatgattgtagagtttgtcttgaagctttaatagtgaggcaggtttaaaattgggggcaaaaaagaaatgggttttagggtgtagaagggacttgcctgatcacttttgctagaaataaatgtccctccaaattaaattactaatgtcgcacatcagatcgtatttaaatccattagaagattttactgttccattagagctacccatagctggtgaagactctgcttatagtggaacctagtttctcagttttccatttatatttatttacctgagctttttgtaaagtagtaagtacttgactgaatttctgctatttatcaaatgctttttgaatagaaataatgagttaataacatttagccttttttggtaaatagtataaacaagatagggcaaatatgtaaactacttagaactttatctaccttgcatattttgtacctcttatttgcatatgcatgtcacatgctccttatgtaccatgtgctattactgtgccggggtactggggctatattgagtctatttcctgtctttgtagacttgatggataatttggacagcattgtgatattccaggtttaagagtcttaaggttcaagactacattaaatgttaatgtagtccaacatttcttgaactctgaaatcctctgagcatcttttcatgcactggcctaaaatgttttcatagcccagcaaaaggctgattacttatttccctcctattgattttttttgagatggggtcttgctgtgttgccctgtctgcttgtgaactcctgactccggtgatcctcctgccttggtctcctgtttatgttttaaatagcatttctcaaacctatttgagcaaataactttcctgttaatatgtagtattccttgaaagaattgaatttgtgagtccctaatctagacacttttaaagaagaaacaaaactcagtaacacatttggataaaaacctgaatatgtccattttgggatgaaaggaagcagctttgtttaccatgttgaattaagtggaaaacatcttattttaatcatgattgatagaaatctaaatttgtaaattctgatttttatgttttttttacaatgaaaatacattttaaatgtcaccatccccttccccatgaagtcttcattacaactaattttgaaaatactctctcatttatttatattatatatgcatatgttctactgtataattttaaatacttaaatggggttatctttttgcattgttctgtatcttttttcagcttaataatttaccttgcttataattattgtcagtgcttgcggacctgctctttatgcatttttaaccattgcataaagctggaatgatggacatgatttctttaatcactccaaattagtcatttagttgtttccagttttttagtattacaaataactctgcaataaacatgtcttgggtatgcattcttttagtttaaaatagtcttgttccttcagaaagttgctcaataatagacttagaaattcttttgtgctaattactgtaattgctcattttaagatctccttttattgttttcatagtatataatcctaaactgttacaactgaaatagtccttgagctaagaaagcaatgtggcttaaagataggatttctaaatagagacttaaaaattaacctttttggagctgtgacttcctgatgaagtggcagcacacaggctgaatatgttctacatctggatggcccaacatcatgatgctgtgatttgcgagaagctctctgcctgcctaggctgctggaggatggcaagttaatttatttgttgttgggagacctccccctgcccccattaaaaaaattattttgaaatacttgtagattcacatgcagtttcaagaaataataaagagtaattccatgcaccattttcctccaatagtaacattttgtgaaactagtacagtatcacagctaggatattgacgttaatatagtaaggatatatgtcatcaccacaaaggtacacctacttcccttctatctctcctctctccttcatgcctggttacaaactaacctgttctctctatataaaattttatcatttaataatgttctgtaaatagactcatagtatgtaaccttttggaactgaagtttttccatcagcataattccttatagattcattcaggttgctgtgtttatcaatagtttgtttctttttattgctgaatggtattctgtggtgtaaatgtactgcattccatgagcatggcatgtccctccatttatttagtttttctttgatttacttcattagcattttgtagtttttgtagtcctgtgtatgttttggtagagttacaccctaagtatttaatttctttgctcattgccagtatatagagatacaacttattgaactcactttttagtttatgctagtttattactaattatcaatacatgctcaagatatgtcaactccttttatttttattaggtgtcacttgctacattttgtggagaataccgatgctgttgctagaaagtgctgctgtcacaaagtgggtttatagatagtaccacgctatccttcttcctaggctagattagaagttatttatgtgctatatgcacatagagtttttgattggtctattgcaaatactatggcatctgaaattttttttttttttttttttttttttttgagatggagtctccctctgttgcccaggctagagtgcaatggcgcagtctcagctcactgcagcctctgcctcccgggttcaagcgattctcctgcctcagcctcccaagtagctgggattgcaggcacccgcaaccacacccgggtaatttttgtatttgtagtggagacagagtttcaccgtgttgaccaggctggtttcaaagtgctgggattacaggcgtgagccaccgtgcccggcccctgaatcctatttttaagtataaaaagtcttttttcagctctggattatggtgctgcaagctgatattcttctcatggcagtaaacagagaagtcctaggggtaatcttacccctctggggagtccaggatatctgagcatctcccttttctttttactgctagaaagaatttctgctagtagaatnnnnnnnnnnnnnnnnnnnnaccccccaccaccccaccaccgcagccatcattctgttttctgtctctgaatgcgactactccagggaacctcatctaaatgaaatcacatagagtatttgtccttttgtgactggctgatttcacctggcataatgtcctcaaggttccaaaatacacattttcctgctgagcaatttagtctaggttaagtcatacttgaccatatgccctagtttagcgtccagtttgtgaacattctttacctgagttattgtaattctaatctcttatgtaaaactgcaggtagtcagccctttgtctccttcagttctacatctgcggattccttcaactacagattaagaatatttggggggaaaaacagtaaaaaaaaattacaatacaacaataaagacaacaaatttaaaaactagtataacaactttttatacagcatttgtattgggtattgtaagctagagatggctgaaagtctatgagacgatgtgcatacgttatatgcaagcgctgccattttattgcagagacttgagcatccaaggattttgtatccgtgggagtcctggaaccaatcccccttggatactgagggatgactgtatttacaacatgtctagattttcgacaacttgaattaaaccagaaagaatatgaacacacagaagttcatgtgtatatatatatgtgtatgtgtttagaagggagcaagctgttaaacatgggaaatagttgctagtagtttgtaattttatgattacaattttaaaattcaattttgcaactggaatttgacttgattggttagtgccttacagtaattaacctccaaatcatcagaatgtcatcttgttatttaggtaattgaatctacttttcttgtatacagaatgctttttggaaacaatacactgtatatctagtttgtaccaagaactaattgtacacagtcagatacttgcagttcttttggacttgagtttctttatccttctatcagatgtcacaattccctcttccctttgtagcatatgaaagtagttgtgtgtgcactgtatttgagaatgtcaagtaatagaatctctagaaaacattcatgatttcagtcccaggtaatccagagttaaaaataatgttcataaggaagggtagcaaaatttagattttaatacttataggaggtgtgttaattggccccagggccgcaggctttagcgttcagaggactttagccccaaaggttttgtggaacttttccagagtcctcaccagtacattgggaataaatggaatgcctttggaagtactttgaagattgaattcgatagtgttggtaaagcagtctagcctgctgtgattgtgctattgatgcaaatattctctagcctgtattatttttccttggagctcaggaagtgatccccacccacctcaagcagtaaaggaaagagaggcaggagggtctgaccatgtgaggtgccccaataaagcatctgtattgtaaatcaggaatgtaggtattgggtttccttaaaacaaagcacacctacgtgaccactagctggagcacaatgtgggctcggtctgctgaaagagtcagttggttgcggctgtctaatccaattatggatggtcccagcgctcagcctttcagctgctgcccctcccctgcagactctgcctctctcaccctcccttttagggcttggtctgtggctaccccagaaatcacgtgcactcctaggcttcagcgagtacagccttgttaatctcagacatggaaagcaagttgcctaggtctacagatgagtattcagtttccccaccagttgacctcagtgcaggttttgttggttccagtcatttggggtcagcacctgtttgaagccaggacacttagaacaaggtggaggaaaacctgagggtacatacagtgtggtttccttggctcatctaatgcagagtcagaatgattagccacattgcaaattgtctttactcagtggtttaattgttaaccagggagttaattttttttttttattaaacaaagaagaaaacacctctagatttttctgggacagatggccccattgaaagaggccatgtgctgcagcgaatggccaggcctcgggtgtggcaagtgccttccagctcagtgcttgctttgtgctcctttgcctatttgaagacgtggatgaatcaaaatctataagcctatttcagtcaagtattctaaggaacctggaaacacaggggatttctctgttgcctctaatacagtgaaaaaccactgtctttttttgttgttgttgttgcattgggggaagaaagtccaggtttgcatgtacattttcactcataggatttttttttagaatagtttggggaggacattgtgctctggccaataactgggccagtgtctggtcacaagatgatcaggcaggtgcctgcatgactgtaggacagagaactgggcagctagagagcctgtgtggaacgtgaagcctttccccactttgttgccgtcctaaccttttctcaagtcatggagaattgatccttagacattccttacctctctcacccacttgaggattgctcagagcctgggtttcggattgaaatagcactatttctggttgatgacgacattctgtgagccagcaatgtagtttaaatatccacaagagcgccctggttccatcagcgccccttcgtaattggtcatgagacttggacctccttcggggctgggactcgggcaagggagttgagtagagcttctctttctgggctcctgggaaggattcatggcataaaagtgggacttcagcattctctgggcacacctgtctctgtttttgtcctctcctgaatctttctggcctgcagagcagaataaagtcactctgtgccaacctgacttttgttcatgactatattaggggcatggatagaaagtgcccccatagcactctcagataaaacaccttcaaacaaacccagaaacccatgctcacaaaaccacccaccttaaattatgaaactttcaggctgactaaatcctgaaggcgttggagcgtgagcaaagggaaaatggtgacacagagctttgcccttcctaatccaaatgaaaagctctgtaaccctccccccacctttgctatcaagaaatgttggacctttgggaagcagatgtagagtattgatccttaaaacagagacctctcaccctaggtctcttaaaacagagaccttaaaacagagtattgatccttaaaacagagacctctcaccctaggtctcttaaaacagagacctctcaccactttctaactgaagtgggttccacattggaagtactttgcagaaacttctattaccgcaattacttttgcaccaacaaatagtatcctcaactcagaaggaaagaattggaacactcagctggaggtgtctggtagggacatgtgtctgctttttgaatcagtcgtatatgtttttgttcctgtgcctggaggccctttgtggtgtgagaacattgaatttggagagggaaagggagacaaaagagaaatgggggtgatgcttaagggaaagtagggtttttagtttgttcaccacgcttgatggcagatttgcctctggatcctcaggccacgttcctatggtgggtagggatctctctctctctctctctctctctctgtgtgtgtgtgtgtgtgtgtgtgtgtgtgtgtgtaaatagtgatttctctaagttaataaagaatgtggggtgacctcctacacatgcccgtatgctattgtgtaggaacaaatgcatggtaggaatgggtagactctaatctgaaagcatcaagttgtatgcatcttctgcaattaggaatctgctcaccagcacgagtgctgtggtttctgtagttctgggattcagaggagcattttaaagatgtaggatgttggaggaggaggtgcagggatctccccttgggtaaagagtgggagacagtctctgagtcataatctgggaccagtggaaggtcaaagggaagaactgtcctgttgtctgctaagtcacaggcttccttcctgttctctgagccctgtcacttacccaaggtgcagcaacaattagtgtctgtttacacataacagacatctctttcataaaataatttttaaggcatttgtttggtagaagcttccctgtttgggggagtcttttccctgaatgcatgtaaataacttcacagtttgcgcaagtttgcaaacggtctatactgctcagccttgattgggctacccaaggatgcgcccgccctgctgaggtctgacagctctgggaggccagtgaggcctgtcctaatccctgttctggccggtgattcagctccaggtggaggctgtgcagaaacagccccggtcatctttgtgtgaaatacatttgtcgtcttcattttcttttttcttctgctggtatcttcatggttttcagcaaaactgtgtacattacatttttttctttaccatttctccgtagttatttctagcatttttttttcagctgatgaaagcaaatgaagaatttgtatgctccatagtcagtcaaacattgatttctctgacttttaacttagaaagtcattttgcagtggcttgcgtgtgtgtatttagactgtgcttctacaaaaaagcacacgtaggcttatggctcagtttacttgttccagctcactttcctgttcatttaccttcttgtaaaatggaaagacaaacataccttaaacttaactcagatcgtgattgccaactttgttctctgtgtgtaagtagttatattattcctaggttatggcatcttgatttatctttgaaagaagaaaaccctcactgagttgacagggacacattgttctaggcttctacaattgtgctgatgacgctttttcccattggaatgacagggatgataaggtcggctggctagcctttttttaaaatgtagaaaaccacaactttaatttatagcatcatcattttccttatgtatgtagtatgtttcaaaaataatccaatgtcagattcttgcttctgtgatcaaggtcttgtttttgccctttctttgctcaccacttccctgcccctgacgccgagtcctcgccttagaggaggtggtcagcttatattgcaacattgaaaatgttataccttacaaagaaggtgatatgccatttcttaattataatgatgtgcaacagtgacttctgatgtagacctttaacattgggccacgcagctttttctttggaggaggggcatttcaaattggatgatgctcttatagtttaataaagaaacaagcaaacaaaataggctatacagggcatgtgttcttaaactctgtgacagtggaggtgaacccaggcccctttcatggccttgggagggtcctcagctttgggggcgagttatctgggtggaaaagcaccatgggaggaagaagtcagagaggcgggttgctggagctcagagaataaaagcaagtctctgccctgaaaatggccctgatttgcttcagatgtactctgtctgccaacatttagtgtctgtgacttagccaaaggaaatgtacattaactgttcagtttctatgtagtttgtgctctaggattttgcctccggaggatttctgtgaaggaagctctgttcaagtggctctgttccacttgggtttggaaagaggccgggacaggtgatttcgaaggaaggatgaggacaatggaggagatgggcttggtcattgcagtgtgtgaggtggcccagcttatctggcattttggggtactatatgtgccatatgaggtgggtatgggtgtttgaagggaaagggggtggcctgggcaacttgtgtccttgcctagaaagatcatcactctttttatttaaaagaaacatgtgaaagagccatcagggatagttttgtcctccctcttcttacaagtgatcattcccttggtagggcagtgccagaccctgcttgtgagcacagaaaacgccataagctcctcatgaaagcatgtctggggaagcttatctcaaatgcagtttgcacttgcaaaggtcctgtggtatagcgggggagcaggggagatggagtctgggagcggtgaaggctgggtcactagctggctttgtagcctctgggcgtgttgtttttatcctcagaggggccactgcacctgctccatggtctcttcccacagcagacccttctgtctctgtgcctcgaggggctatgtggaaagcagagaaagactcaaccagagtcttcccttaaggaaatcggaaggaaaacaaaattaacggcattagaactgagtatgtattaaaacttctactgtcttacaaaatttagttttctttcttatttttctttccatgttgactcagtaggtaaatggactaaacacacattcatttagggcaggaagaacttcatcatttgattacctttagttcatttaccttataatgcctaaaacaaagcagaaagtgacgttggttaatcaaaaagatcactttcttttttgtgttcttttgtgctattgtgagatgcctcttctccagcaagctgtagttgttcacaaagtaaagctgttcctaagccttcattagattgaagcttgtcccagactttctttaaagaagtttgcatagcttagttcatgctcagatgattcagtgatgatgatgggttgttggttagaaattacttaaaaatgcctaatacattattgactgataaatgttaagacatattctttaagggtctaaatcctattcttgtggagctgcaaagatcttgggggtgtggttgcccttgtctgttgcatcatctttcaaatgcaacagctgtaatgatattctgtatcttgaaaaacttaaaaaagcaacaactaacttatttgtatcttttcctctaatatttagtttttacttcacttgtaacttattacatgtattaaggagtttatttttttatgacattttactcataaaaggatgaaaccaagattggtgatctgttcacatagattaaaatcctgtttgtgaccacttaggtgtgtaatgtgtgacttgtggactgtgtcagaggaagattttccaaccaaaagtacccattggtatcacagatgaaaagtccttataccatctgaaaaaaagtagaaggtggggagaagcttgaaaacctaaggaggccattaggaaaggctgtatattttctgattccgtttaaaattttaagttggtgaaaatactatgtgatcgaaggatgaacatattttagtaaatagagttatagtgctacaatgagataaatttcacaggtaaatgtgacgtagctaatgcataatcattctttgtgttgcatggcaattctgtacaaatagaaggtagcatgtttaacgttcctgttatttcacataaatacagactgagagtttcagtggtctggtttgaaagggaagaaatagaagaaggaaggagagaagttggcagaggagcaatctgctctaatatcctccagtacacaatctagctataggtcctcacctggcagggtttgaggatcagaatggtggctcaggtttagacaattctccctgtttgtggggcccagcagctagttaagagaaaaatcttttttccttccctattaccctataaggtccccaaattcattgtatgtagaatacttgagtcagaataactttcctaacacttaagtttcaggtttgttaggtatgcctgacagctctcttatcaactcccatttatttgctaatctaaatgaaagtttgatggtagagtattgtaaatgtagggaaggtgaagtgttcaccttccagatggtagctatttatctcagcaagaagagcagatgactaacacccaaatacataaccattattatatgacttagcatttataaggcatttctatgcatcctgagagactagagcactctcaaatgaggtttcagagtaagattcatctttgcaaatgaagacaaattagcaaaatcttcctatttttaaagtgtgccttttgatttgatacctatttatttgtttggaaagaagcttttaaaatcaaaaccatgaatctgtggttatcttcaaaggataaattatgataggtagttgttacccaggttaccattttaagatgattatggctggcccaaattaggggatcttttcatatatgtattatatattttaacttcagtcttttaaaaatgaatattcctaggtggcatgggagggtgggaaggtcaaaagcccaaacttctcttacttattggctgcttccttgaacttagcgtttttcttttggaaaagtgagcttttgtttttggatattttgtactgatactctgtgcctacacagattttgttttggttcaataagagttgatattttgccaggggttgcctcccatgagattccaaatacagatgtaagtttaacaggcttctgaactggatgtttctatgcgctgaaactctgtaaacgcgtgtagctttgtctaccattgtatattgctgtattgatttgttgggttgttttttttcttcctcctgaaaagctctggtctgtcctctgctgatacaaagactggtccattccccagggtcactgcaagagaacctccagggcctggccactgttagatattactaatctgtgaagttgctccaaattctcttgccccgatcataaagttccattgagttcaattttatgtgaaggttctttgtcaaaaggaataaatgtttattcaacagatccagttgttgtcagcattgacagatgtgaaaattagcaaatagcaagaagtctcccctttagaaaaggaaaacaagtacttaaaaaaaatcttgtgttgtcaataaacaagtccattttaaaagcatctttgaaggtgtgtaatgaaaatggaggccttaggttgtatcagggtttatgaggagccagcttatctgtaatcagatgttcctgttactgttatcactgtagtatagggcttagttctgccctttaagtcacagactcaagttactcctgattttaccagcagtcagaatacatttttctttaaaaggaaaagagacgatatcctagtgcttctctatactaaaacaggaagagaagcttccttgttgaagtgacagtttagatgttgttattttgacagaaatattagtaaatatgtcacattatcccttgctaaatatttatagcatagaacgtatactctgatgcataatattttatgaaagaaatatcttttgcctcaaatccctttcactgttttgacatgaatctataatttatacccagaggtctgcaggaaaaagactttattaagacccttttatttcagccaagataaaactccatcctaagagggaacaccctggaatctttgagacccttaaaggtggggtattctgaaatacctgtgttcgttcctttgctagaatttagatagcttcacttttgcaaaaaggcacaaaatgagggcaatttttgatggaaaattttagtttttgagatgaagcagggggcacagtggcgaagcgccctatcttagcacttaggtagcagccgtaacaagtgtcctgggtattcctccctagaaaggaaatgttggtcacaaatggcagtgtcctctgcattcagttcagctatgtgactgaaagacactgttcttcagcagctgtgagtttacaagatgtcgcacattgagtatttttctctagcttatttagaaacgccagtctagacttccgcagttttggattcgtggccatagttttggcctttattagatggccctcaaaggtacttttcaggtggacattgatttcatgccagctgtcagagatgattttccctagaaatggctgggtatatggagacattctgtattagaatggaggtatacacccatctcttctgtattagagagcaggtgttgccccccgtggtgctcagattgcttagtgtgagaaggaaaagaccagtgataagaggaggaaaactgcgccttccatgtagctcagttaacagcatcatgattctccaggatggccccatttctgtttttatttacaaaatggacttgagaattaattagtaagcaaactgtctccattaggtaagtggcattctgatttgtctgtgtaaagttccatttcccaagtaatgtgttccaaagcatttttatgtacaactactggaaactgctgtacaaatgtttgctgctatttggttgtaacaaaatcagtaatgagtttcaaaatggaataatttcagagcccttcatctacagtagtttgggaaacacttgaaataccaagtgatctgaattcactacaagctctccaactggaaaatgtgcctggtgtcgtcttcaagcaagaatcccccgccccttaaccactgctgctgtggacttgagtcttcaaccttgttttgtagactttagcatttgtattgtgtcatccttgacacctccccaaccccagccttcccagctttgattgcttaccttagcaatgctctcagcttggaccagaaggcacggatgtttccctgaccttaacctcactgtgtatcagctcaaggaagaagccagatttgctgatgttgtaagcactaaattatgttcataacatttaaccctcacatccataagcaaactaagtgggaaaataaagattgactattgtagcagtcatagattgtttaggaagcagcaaaaaggcaaatttttctttaaagttcaaaatggggcgaaagagggtaggaaaggaaaagtttattaagaaaattgtatactacattaatttgactttgccgtctagacttaaattaaattcatgtatttttttggtcttaacacattgacatgtatcagtaagttaaaaacttaaaaatacacaaatgattagattagcattattatgtgtttctttcttgttttttgttttgttttgttttgttttgttttgagatggagtctcactctgttgcccaggctggagtgcagtggcatgatctcggctcactgcaagctccgcctcctgggttcatgccattctcctgcctcagcctcccgagcagctgggactgcaggcacccgcaaccacccctggctaattttttttgtatttttagtagagacagggtttcactgtgttagccaggatggtcttgatctcctgacctcgtgatccacctgtctcggcctcccaacgtgctgggattacagtcatgagccactgcgcctattatgtgtttcttatagaaaatctctctaattttttaataagcatgtttttacaaatgctgtttcctgagaactgtcgcaccacatgcgacatgccatgcatgcgactggaacatgccagatatttgtgggtggtcccttcgtgtcacctgtgccttcttaccaagtaatttgaaacacccgtgtaaactacctttggcaaataggatagctaaatcaccgctaagatttataatttactttttggatatctgaaacatcaacaatatagccatccatggcgtgttcctctggagtgtggtccgtgccgtctctgcctgctccatctggctgatcccaggcaggcagctcagctctcagcagacacagatccccagcacatatgaacgtgaaagaggcttctccgtgggagcgaagtggccagcaggtgtcacaggctgtgtgggcccagcatcgtgtgggcactgctgggggaatcccatcacagcatgtgctggcgttagtagtagactgtgtgtgtctcagagggtccagaaagtaatacagtaaaggcgcctgggggtgtgtgggggtggttggttggggtttgcttgttagtttgttgtaaaagcccagcttttcattcttggaaagatttcagccaactcgagagggttacctgccaggaatgctgcagaagcaagaactcagtgggtgagcacttccatttcttcaacaaatgcttctgagtccctgacctgtgccaggtgctcttcttgagctgagaatcctgcagggaaaaaagagataaagaccccatagtcctgtggtttaccttctaatgagcatacttttgtcgatcaaacagggtgacctctctggtgtctctgcacactacctgtatggtctttccgtagctgatggggtctcctgactagtgattggtgattttaatctggattttgccacagcacttattttctaacatatgacttaatttacttaataattgtgtctattgaatgtattcttatacatacacacaggcatgcacacacggacacgaatataagctttacaaggacagaaaccttatcttttatttatttcttccttgtgtatcctgagcactgagaacagcctggcacaaagcagggctcaggaaatgtttgctgaatgcatgttcacactggatgtgttcgaaggctctcactcgcgactcctgttggcttgtggagagtgcatctagctgtaaaagccatggtgcttggatgtcttggggtgctgagcctgttcccccctcatttgggggtgtggtgctatgctggcgtttgggtccatgccccgcatttctgatggctgccccatctgccctgtgtggggtggcagagttctgtgtacacagagttacatttcgttgttcctggcttctctatggatgacagcagcactgataaatgccacacctgctttctcagcagtcttgcggggtgatttttcctcttaaggaagtcacctgatgtccatgctgagtaggaaatgcatccaaagctttgggagctcagtgttggcccctgggctgcagcccgagccccgttttagagctgtgtctcccaggcagctgtgatgactgctcgaaagcccactcagggggaaggtaaacctgatgcccgggtgtttggacagtgagcatggcgagtggaccgttacctgtgcatagagttgttcatatgtggtgacagatgttgggctgttatttagtaacttcaaattgtttttctttgcgtcggagccatgtctaggttctgagtgcttctcccaggtcagatggagagctcttcatttggggttgggggagcggggtggtgttttcaggtgcccaaggcattccatgcacatgcacctgcagggtatgtgtcatctggggtaagacagagccctcccggttcctcttctggatgtgtgcttttagtttttaaagaatgtcagtatatacattgccatttattcaacaaatacggactgagcattctgttgtgctgacgtagctacttggggttacagagacaaagccaactccattctccaaatggaaaacaaatggaaacattctagtggtagaaacagacaacaaacaagtagacagaaaataatgtcagacagtggtaagtgctatgaaaaaaatacagactcactgattgtgatggagacttttaagttggattctcatagaaggcctttctgaagaggggacatttgccctgccactgtgaatcagccatgagaagacgtggagaggaacatgaggtggtaggccccagcgagggaaagatctccatgatggcatcgattattcgctccacaaatattattgagcacctgctgtgtgccaggcactgttcctggtgtcagggttatagaagtggacaaaatgaggcctctgcctctgtggagcttttattaaagtagggaaggggatgggagggctgggtcacatgttaggtgtggggtacagggtacgtggtgccaggcaggtatccgggtacctttttacgtagggtattcagagaaggtctctagagaggtgacatttggacgaagacctaaaggaaagggaggggaaaggcgaggagcttggagagcttggtgcatcttggtgggggatggggtaaactgagtcagttatgtagggccctggaggccacggtgaggacttcggctttgactctgaaaggagatggcagagtttggagctggtgtgtacgttaacaggaccatgctggcagctgcgttaagagagactgtaagggcaaggacagaagtagagagaccagtaggagtaggctgttgccccagtgtagggcagagaagatgaaccttagaccaggatggtggagatggtcagtggagagaagtagtcagagtctggaagcaccagcaagactgtctggtgcacacaggatgcacgtgggatgtccagtgaggaggatgagatgaggttgggtggctggagcctggtgagtgacaggcagagagggctattagatcacatgggccctggagccatggtgaagaatttggattttgttctctgtgttggaaagttagcagagagcttatatggggggtgagatggcatagggacaatgttaataacagcaacgaatatttattgagcacttactgtgtaccagctgttgcaacagcctctcaagggttcgttctgctattagagccatgttataaatgaagaaactgaggcacagagaggttagctaacttgtccaagatcacacagttagggacaaacttgacagaattatgtgtgtcctggtatgtatttcagttttctttagggaaggtaccacaactttgggtaactatgcccctaccccaggatttaagatgttttgatggttgaagggcgatgtttaagagtgggaccagagaatattgaggtattaaaatctcactaaatctgtattcattatatctgtattcatggtataattcatgtgcctccccctttcgtgagcccctcaaacatgatcatggatatgttttctccacccgtaaagtacgttcatattcatagaaaacccacagagaactgcagacctgaaggtttctttgtaagagctttcattggatagctagaagggctgcagtaagtttaaaaaaaaaaaacccaaaccaccctggattccaggctgcacagcctctaggaggtgtgggtaatccctttataaagcttggcataatttctgttaagacttgcttattttgctctcagcttgctatcttgatatgtttgcctttgaggaggttagagttattgtgatttaatcacagaccatgtatttcgcaagattcatttggtatctccagcttgttttcttgtttcctcggctgtcagtccacaggcagaggtgggaggcggccggcatgggggaccgagtgtggtagaaaggagtgtttacttagcggaggggagtgctgagggctgctgttaccttcccagaatggctgatccccagcagtgatgagcaggctgggatcgtggtgttaaatttggtattttctagaaatatatagcaggctttcccctccacctgccccccttcaaggtttcgaagccttgtgttttgcaagagttgagaggggaacagttaatagcttggattatcttgtctctggagagaatttatgtatcaattcaccggaagactgctctggtattagggcaacaagaatggttttatttctcccttcctttcctgcactctgttcttatgtaattcttgtattaaaaccattcctggtaaattagaacatgctcttgtatttgggccctgctttgaagaaggctgctgagtctaaaaagtttggtagcctctcgtttctcatggtgatttctgagatttctagggacttggtgttttacagagcttgttgagttgcacaaaccagcctccttggcccttctaggtgataaaagatgctgggctgggagggcagctgtggaaaagggtgtgggcgagggagacagtgcttcatcctgcctggatgaagcatgttggttgttggtttattcataaattagaaaaatatattaagaattgaagttgttccttatctcataagatttctagcaggctgcataaagtctgtagatggtaatatccatttaaaagtggacaatgaaaaaattacctctttgggagttgtgttgctatctctaccccaatttggcaatctttaattaacttggcaacccccgttttaccaacaaagaacaacctttgattaaaaaaaaataaaatgtcagggagtgaaagatacggagtgtgactcagcagatgggaattcctttaataacacgctgggtgttagcgttagaaccgccactgaacagctctgcaggatgccctcccagccctccctccgcctatttggattagaccaggagactgcagcaaacttctcaaggggaggcgaacttggtgttggtatctgagcgattgtctgtttcaattgtttccctctgtcttggaaaacaccggcacaaaacacaaatccagtcccagttcctgcagctgctggggcgaagcaggctttttatgaatgaggcccagaagggggaggagagggcttgtgttacagcagcagttgggtaatacatttcattcacttgcagccatctagcccaggcttcattttaaaggatattgttcatttttggcaattcagattagactttttttcttccttgtgcaactgttggtaagttagaacacgaagcatgtgtgtgcattctttttgcttgcttttttgagtgtttgctcctttagttgggataaatggtaggagaggtaggaaggctttgtcatccccggggaccttgcttacttctccctcccagcaccacttaagagaagaggaggtggcctccctctccccaacctcagagccctcaaagcccttgatagtgagcctgagcacttgttaggaggtgacttctacctggggtgtgctggggtccacatgtgccagtctctctgccctgctccccgtgagcggctctttatttgtggcccttgaggccccattgttgtggccaccaaaacctgaattggaagctgtgtgacaatgctggtccccctccctgcactgcttcctgctgggggcagaacaaagagagcgggcattgtctctggcataaatgaacctctatcaaaacaaacacccagagagaggggcagcctggttacagctgcctgtgtgagcctcgacagtgggcctcattcctcacaaagggagctttgaggcccggaagaggcctttccttgatgatcgagctgtgcacagggagcaaaccccaagccgactgcttgtctgtgccaccctcaaacaatgatttccccaaattggacagcctgggtttgtatccttgagcacggttttgggaagagcattctgcatgaggcattgtagctatgtgtatggagtataattctgttttcaggttgctctgccacagaggttaagaactccctcttccaaggtagacattgagaacagagacgaccacactgggttttcactgcagcttttaaacaggatgactcccagcccccatccccgtggctagcagcaagcagggactctgaaacactgcaagccaatggactgagcatcttacttttgctgtccgtgttttggtgttttgtaaacccatctggtaatgaccctgatgccccatgtcccagcaagggcataggtacctgccattgtgcaccaaagtccctttcctcatggccctggctgttctcctgcatggggtcatgtgtgtcccgttaccaagttgtggccccttttcaaccttgagtgccacatctgggctgttgtaggcatgggtagtacaagctgggtttgttactctaaaaatgaaagggaggatcagttgttaataccttcctgtaggtgcgagagggaatgagttgaggattcgatcactgtttatagccagtctcggatcctgattgtgaagtcattctttctggataataactactatatccagcatcttgagagtataaaataaaggcacatgttgtacgtcatctctgagatgtagcgatggcttggactttggaggctgatgagagaaaactcatggtggtgagctggagcagggtgtggctggcggattctgaaggtgctagccctagttttacagctgaccagggaaggtcattgaaccctacagtcttggccctgagagaaccttggaggacttaaggatggagaaaggtgacaaaagagatgcaagccaacagcaattttgtggaacaaagtgtgtacaggatttgaacttaactctgcgaaagacaggggttgcttgtatgcacgaattcacatctgaagaatgcatctgattgtggctgcaatttctgtggacgtgcaaacatctacctgtgcattttatttgtctagcatcattgaaagagttttttgcttgagttgatttcccaggtaattgaagcttacttctcaaagcacaagatattttttctcatatattagcggtcttaagtgagtgagacccctaagaattcttaattcctttatcttacttttcctacaggaaacttattatgttttcctagataggaattgtgctaccaaaaatgaaaagtaaacgtaatatgtaatgttctactggtaattgtttccattttaggttgacaccgaactaatgatatttaaattgtagctgacttgaaacacagtgaaaaaatggtttcctgctgtttttttaaagctggattcagtaacatgaaggtaattaaaaatgtacagatctcagtaatagacagtcatatgttgcttaatgacagggatatgttctgagaaatgcattgttaggtaattggattttatcattatgccagcatcatacagcgtactttcacaaacttagttgatacagcctactacacacctagggtccatggtatagcctgttgctcgtaggctgcaaacccgtggagcatgttgctgttctgaacgctgtaggcaatggtaacacagtggtaagtatttctgaatctaagcatagataaggtgcagtaaaaaatatagtgtaaaagataaaaaaatggtacacctgtatagggcacttactaggagtcaggcttgcaggaccagaagttgctctgggtgagtcagtgagtcagtggtgagtaattgtgaaggcctggataaatactgtacacttaggctacacttagtgaatattacattttatttatttatttatttatttatttatttatttatttatttatgagatagggtcttgctctgtcccccaggctggagtgcagtggtgcaatcacagctcactgcagcctcgaccgccaaggctcaagcgatcctcttacctcagcctcctgagtagccgggactagacgcacacaccaccatgcctgactaatttttgtgtttgtagtagggatgaggtttcaccatgttgcccaggctgatctcaaactcctgaccttaagtgatccacccgcctcggcctcccaaagcactgggattacaggcatgagccacggcgcctggccacagttaacttttttaataagtagaaggtgtacactcttaaataactataaaaagtatagtaaatacataaaccaataacatagtcacttattatcattatcacatattatgtactgtgcactgttgtacgtgctgtacttttatacagctggcagcacgggtttgtttgcaccagcatccccacaaacatatgaggaacatgtacatcttaccacggttgcaatgtcactaggcaataggaattttctagctatattctatccttacaggaccactatcgtatatgcacttcatctttgaaacgctgttagctgcctcatgactgtatttctattcctcagtcatgggctcaccatgcagtacacatgtgtggtcactggagggaatggaagaacactgaggaaatgcatagcctgtttcatatatttattacactattatttatttagaggaatgttaagaaatcttgcttttatgtagttttagaatgccatgaaatatctagttggggcattatctgccattttgcaaggtaatcttccacttctgaataacgttacaagtaacccgcgtttggaggactgatttgggactaaggcaaggaatttaggaggcacaagtagaggggaagaaataaacacatgacttttgtttttgtttttgtttttgttttttgaaagaaggacagtggtttgcttgttgattctgctttgagaggatggggatgcactccagagaaagtgaaacggggctatgggaggaagagagcagcgcacacacagcacctgcatttgattgtgaatgcgattgtgactccttaggcaggaaggagagtgctaagaccgtcatcatggacactcagaaaatacctgctaatccgtttactggaagatacagggagctgcagataattattgttttttaagatggagtttcgctggagtgcaattgtgcaatctcggctcactgcaacctccacatccccagttcaagcaattctgcctcagcctcccgagtagctggaactgcaggcgtgcaccaccacgcctggctaattttttgaatttttagtagagacagggtttcaccatgttggccaggctggtcttgaactcctgacctcaggtgatcctcctgccttggcctcccaaagtgctgggattacaggcatgagccgccactcccggccgctgcagagaatttttaaaataaatgatagattctcacagataagaagaacaggataattatttgccaaagtttgaaactgccattatattcaaaggcattctcttttgggagtggttttatatttaaggtttgaatttagatgacctcaatcttgaggtgttatcggagcattacaggggagtcttatatacatgcaggtgcgatttaatttgaagatacttccatttaaactttatgctgccagagttggccagctaagcaaaaagaattctgataggtcttattctcctccccatcccacacgctgattttttttttctttgtgtttggccgaaacattttacatttctcatttttcacagagctactgtttctctaggattgttttccctgaagtgtgtaccctgtgtttgggcagagcagcaagaccagacttccaaatggcatgctgcgttttaatgtgctttcataattgtctgttccaaaagggtgcctgtgtgtgtatggtgtgtgtgtgtgtgtgtgattcagagcacctgagagcacactgcccgttgtcccctccagcccttctgaaatgcaggccaccctttctgtttcagttgccccttgggtggcagtctgtgataactcaaggtcaggaggaagtatttgttttggttgtcttgtttaactaattaaatctttaatcttggtccttaaaagaaactaaaataaaatcgtaaagtagttctgataagtccttgccataaattattgcttttgtaaacgcacataaaggactctgaactgttgctactcataacatttctgacgccaaatgtgtggggttttgccataccaacaaccagttctctaactctccagacaccaactgggggccttacaattcagtgcagttctgacactcaccacctggagttagcacagactccacagggatgagggttcagtcccacgagtctgcccttgctgcagatgcgagtagcaggtatggggtgcccacacttctgtctgacttgcctgaaaggttgagagtttgttgccaggccccttgctttcaggtctgataacttgctaggttattaaacctgaaacttgataacttctgtagatgttgaaattagaacggcctcactcacctgggctcacaaaattccagaaagtagttgacgtcctattactggtttaccgtgaaggctctatgtccagagtggacaggacaagtggaagagtggcacagggcgaggtgtggggggtggcgtggagctccttttcaggagtctctaagaaggtgggactccagcggcaatgccttgtccatgtgctaagccagccgagggcgcacgaagtgctgtgtggtgtccaagctgacttgggagggaccagtttggggccagccccccagcctcacttgtcatgtcccacctctgctggcatctgtgggcttaaagtgccttcactcccatccttttcaactatttcttgattaaaaaaaaaaaacaaaaaactgttgaatagtaggagactctctctctcattggtatttgtgggaataaatattaaataaacactttctaataggtgttaccaggacgcctaaggaaattatctcacagagttttcaacactgtgaaaagagaagctgactgccagggagagatccctttttcctagtccttgtgaacatgtgctggacagccaggagtggcactgtggcaagaaacacccgttctctggcattagtaagagggatatagccaagggtatctgtataccagtgttaggcccatacatccataaaacattgatgtgagagctttagggcacagctgaccctaagcctaacgtgatcattaatgtcatgaaaattggagaattggtcaggcgcggtggctcacacctgtaatcccagcacgttgggaggccgaggtggatagatcacttgaggtcaggagttcaagaccaacctgggcaacatggtgaaaccccgtctcaaaagaaaaaaaagaaaagaaaattggagaatttataacgtctgatgtgacctgttctttaggtgttgaaattagaacggcctcactcacctgggacattcttcagctcatgccctgtacctggcttacagttgctcagtgaaatgctttcttgattgtagcatggtgggatttttataaatccaaatgacttagaggtaggtgtcacatttttagcagctaaaatcatactaatcgtaaagctcagattcctgtaagtagggcgctgagcacaggctgcatcctggatatatgaatagatgaaccagatcgtgtacatgtgggacacgttctttgtcctttgggactttcttttgcttggatgttggtagtaaccatgtaagttcgggcagctttctagaaactttccttgttgtgcaacattatgcaataaatgcactgctttgtgatatctgagacgttttggttttcttcagcttgtttgagttaaatttagactcctggcatagttttaggtttgaatgcattctctgagataggataaggaccaaaacatccactcagcagccagatgggattttatccttgtgctgccatttttgagactcatgcctctgtttcactctctgtaagatggcattaatagtgagggattgttgtgctgtgaggtttaaatgagctaatccctgtgaggagtttacagcagggcctgggccatagtgaaacactgtgtatgtggaagccacttcacttttgtcatagctttgttgtcattagtgtataccctgtctccttgccgtttatgggtccttctttcaagcagtcggattttctgtctgacatagtataagtttagaggaaacaatagcagctgtaagataatagtaattttccttctgaaatcattttggtgaatttagtcagaatatctgatccataaactctcattataaaacattgccttatgattggagttttttctgagaacagttccaatgaacatgattttttggtggtgaggtactatttctgtgcagtaatgaagttgtgaggacacacagataccacatccatgttgtttgggaattgtttgggaaaggtacgtgggatagcctggcatggggaagaatgatgttagggtattctccttgaggagctcagaataaccaaaggtaaagcatttggtggtataagatatattcatcttaaaaataagttgaaaataataagatattgggagatgttagccaccgaagtaaataactacagtgaaatagctctttattaattttgaaacctaaagttgaaagagttccgtattatttgtcagtatctttatcctcttcaaaaatgtttccagctttgggataaattgtgaataattgtttcactttgttttttaatattggctatgtagtgattttgcattgaactgtgatataagaatgatcatcagccccttgagattactgtgtgtacctgtgtcaccagtggcatataggggcttaaaagcaagcaagtttaatatatacattcattgagaacacactgtagactgttaggattttcggtgctggagccatagtgatgaatatgacaaggccctcacccttgaggtgcctatagtcgtgtggaacctaggtcctcgcagggactctagggcaggtatgttcttgaaagatttttttttttttttttctttttgaagagacagggtcttgccttattgcctacactggagtgcagtggtgcggtcatagcccactgcaagctcaaagtcctgggctcaagaaatcgtcctgtctcagcctcccgagtagctaggactacaggtgtgcaccaccatgtctggctaatttttatttgtattttatttttatagagacagagtcttactctattgcccaggctgatcttgaactcctatctcaagtgatcctcctgcctcagcctcccaaagtgctgggattacaggcatgagccactgtgccctatgtaaaagattcttatcaacagttaaaataagaagctgctcaagacatttacctatcctgaatgtttcaggccctcaaggtgccaggtagctgcaatatagttctagtgtagaaaagaaaaccctgatgaggtctatatattccaggactctgtctgaggccctttgacactccgggggcaccctgccgtgaccctgactctttcctgcatgtactgaggatggaggtagcctatgggtggcacagagatttgctgtctggctagcagtacttcagggtactgggtggcttgaggacctcctgttagaagcttggattcacttttcccaaggcaaccaggattggattctattagttctgggtcttgagagcctgcaagggcttccttctgcgaaggtgagtctgggagagacgccatggagtcagtgtgagttctgcagcctcccaagttccgctggcgtgagaggcttgcctggtgccagggctctgggcattgggaacattgcctggtctaccgggcaagaaacgtgaaccaccgcagtgaactggcagcgcgttggcatttttccctccatgtttttataaaaccgctgagtagacaccagattataaatcctgtgtaaatagtcttgaagagtttctgggttcagccccagagaagactggtttgggttttgaggaatacttcaagaaaatgtttgttggttctgttttccaacgtaaagtgctgcacaaggactgtgctgtgagatccaggagtgtcttttcagccctcagtgagtgcctgcaggggacacagctgctttggaggaatgtggttccggagggtttcccactctccatcctagttgctaaagtcacgttccacgtattgtgttctgatgatagaatgaaagcccactccccgcaccctggggtctaggtggggaaaggagaggtgtatatgggatagccacggggtttggcatgagctcagtagagacagcaaactgacccagacagactcccgctttagggaagctgggatgaactaagtgaaggtgggtcatgggagcaatgctgaaccactttggtggttacagtgaaggctgctacacacccagctttgggaggtggggcccagggtgtccagctttgtagaaaggcatggtgtgggggtggctggcggagggggtggtgggtggttttcctcttgaatctctgagaaccttgactggtgtactgctctctgctttcctaaggggtccgtagctgtgctggtggtttgcttggtatctgtattacatccactctgtgcttcagcctgtttgtccagttactgtgtctagtgaagctagcattcacatattttagattaaattccacactccacccccaaattaaaaccctgctatttaaggtaaaaataattttaaaatgttttattttggtctctttggataaattaatcttgaggaaagcaatacttactgaatgttgatgtgtgtatatgtctttctctttgtaccatacttaacaggcaagtaactctcttgtaaaatcagattctaaatgattttcttttcttttcttttttttttttttttgagacggagtctctgtagcccaggctggagtgcggtggcgcgatctctgctcactgcaggctccgcctcccggcttcacgccattcttctgcctcaacctcccaagtagctgggactacaggcgcccgccaccacgcccggcttatttttcgtatttttagtagagacggggtttcaccgtgttagccaggatggtcttgatctcctgacctcgtgatccgcccgcctcggcctcccaaagggctgggattacaggcgtgagccaccacgcccagcctctaaatgattttcttaagtgtaattcaggagttggcaaactacagcccatgctgccacatctggcctgccacacctgttgttgcacataaagtttcattgagtcacagtcatactcatttgctttcatattgtctgtagacaacctagaatgttagaaaattctttctctggctggacgcggtggctcacgcctgtaatcccagcactttgagaggctgaggcggccggatcacctgaggtcaggagttcgaaaccagcctgaccaacatgggagaaaccccatctctactaaaaatacaaaaattaaccagatgtggtggcacatgcctataataccagctactcgagaggctgaggcaggagaatcacttgaacccaggagttggaggttgcggtgagccatggctcatgcatgtaatccttgcactttgggaggctgagacgggcggatcacaaggtcaggagatcgagaccatcctggctaacacggtgaaaccccgtctccactaaaaatacaaaaaaaaaaaaaaaattagccaggcgtggttgcgggcgcctgtagtcccagctgctcgggaggctgaggcaggagaatggcttgaacccaggaggcagagcttgcagtgagccgagatcacgccactgcactccagcctgggtgacagagcgaaactccatctcaaaaaaaaaaaaaaagttatttctctatgtaaacaaagaaaactctccttccttataacttgtatgtgttgggtctatttgtattctgtgaaccataagaaataagtcaactatcagctgggcgtggtggctgacgcctgtaatcccagcactttgggaggccgaggcgggcggatcacgaggtcaggagatccagaccatcctggctaacacggtgaaaccccgtgtccactaaaaatacagaaaattctctgggcgtgttggcgggcgcctgtagtcccagctactccggaggctgaggcaggagaatggcatgagcccgggaggcggagcttgcagtgagagatcgcgccactgcagtccagcctgggtgacagagccagactctgtctcaaaaaaaataagtcaactatctcaaggtaattacccttttgaatacttgaggacatcttttctgtgccctctgaatatttccttccccagataaaatatttctagttcttttacttgttctttgtttcagagttttaagtctccatttgataaagtatagtttaatagccttcgaaaccacatcgttgagatttaaaaagccctccttgagagacatgaccagtagaaatcataccaggaccgtttagcaccctaactctgggagccatggctcttgggatgcggctgaagattgtgttatcgtcctgaagctctcttggacagctgagtcaatgactggaggtaggaaagttccttgaactctttcttgtgcccttccagctgtgagctgtgtcaccattgtattatttttacattgttgttgttcttgaaaaagcttttttttttttttcaaggcagagtcttactctgtcgcccaggctagagtacaatggtgcgatctcagttcactgcaatctccgcctcctggtttcaagcatttgtcctgtctcagcctccccagtagctgggattacagacgcctgccaccatgcccggctaatttttttaatttttagtagagatggggttttgccatattggccaggctggtctcaaactgctgacctcaggtgatcctcccacctcagcctcccaaagtgctgggattacaggcgtgaaccaccgtgcccggccaaaaaagcttttgaaaacttcgtcgtataatattatggccatccttccaaacgtgacctttttatgttgtattttatctaactaatttgcccttgcccccaacttttatcttggaatttcttacgtattaatatactgtcagggtccctgcttggggcattgtccttgggcttgtcattagataactccaagttggcttgactccagaggagctgccttcacacgtgctgtgaaatgtactgttgttgaccagagaccatcgttatcattaagtccacaaacctgcttcctgtctcttaggctgttccagtcttctatcgaaaaacagtggtttaagtggcttctccgatagtgctggtgaattggaagcttctcgtcatcccccttggctggggcgaggcttacttcctggggccttggcagttttgatctaactgacttatgttacctttctgtattaatcaagcctttttattttccatacttctgatgctttgacatcttggggccttgctgaccctgaagagaccagcccccctagggttagccagttcctaggtagtgaatgagtacaatgctcatatgcaaaataaccaatccaaaggccacgcccctcactcatatgcaaaataaccaatccaaaggccaggccccttaccacctttattgggatttcatactccaggccaatattgccctaccttaatcaccctagggccagataccaggcaagagacagcccctacaccccagagcctgtcagaattactccagccagctagtcctaaacctgcttaccttgtgtgatttattccttcccaaggaaaccacaataaaggctctcctccatgttttcctaccattccctctgcctcaggaccaaccttggttcttctccgtgtggccccttggcatggtgcactacctcttcttggggactgtgagtaacagactttttcagtggcaattgtcttttaactgttggcctcaccgtacctgaatagcagtaaaccctacatcttaaaatactttgagattgtcacatacagtacccagaataggtgaggatgaaggcaatttactggatgcagagcggccccagtccattccttatgtccgaatgctaagacttgagaaaggtggagaggagcctgactatcaagagttgccttcttggatgaagtgggctgaagacacacgaaccccttccattaatacatctacatattttccaccattgtaattgtattaataattggagaaaataacaatgactgtcaacaacaatagcttaatccagtagagatgaggtccggaataggttctggcctacctcagttcatgttttttactttcaatgctgaagcacaagcaaatgcaaaagcttctcttgaatgttttgtaaattgtgggataattgaggtatgtgacatggttaataacccagtgtctgctcattgagcactgggttattaaccatacatagcaaatggagcacatcatcgtgggttgcttgcgtcactagatcctgttgcaaaaccaagattcaactttaaaatacattttaatttaagttactctttctggcatgaatgatacatcactttggagcaacacttaccaggcagtgaaagctttttttaatgccctgtgtagcactgctttcggtgcccttatatgatttggatggatggatggatggatggatatagccacagggtcttgctctgttgcccaggctggagtgcagtggcaccatcatagctcactgcaacctcaaactcctgggcttaagcgatcctcaacctcctgagtagctgggactactacaggtatgtgccactatgcccagctaatttttaaattttttgtagagatgggggtctcaccgtgttgccggggttagtctcagacttctggcctcaagtgatcctcccaccttggccttccaaagtgctgggattacacgtgtgagccactgtgcccagcctgtttatatggttttaaaaacaaaaatgtatatgctctcaagatggctttcagagagcttattagtgtcttggccatttggaattccatttcacttaaattagaagagtgaaagagaaatgaatggaagaccaaaaatggggagaagaaattgtatctgatataagcgtggctctacctgggagaatggccattccgaattactggaaacaggaagaagacttgctatgatgcttccttatatctgtgggggaaaatcaaacttacattctgaaaggaaacttaatacttcatgtttttaaacacaaaaggatattttttcagagtagcagttataaagttgttagtttaatcttttagttcagctttttttcttaccagaaaaataattagtagtacaaaaatttatgcgtttgttttagctctattctgatactgttaagaagatacatgacataaaaacaggaatattttcagtcagtgattacaatttaaaatcatattcgaaatttaataaaaagtttaaaagaaatcaccagcataagatgttgtcatttggctcttggggcaaaccagctctcttctggtgaaagaactttctggatgaggtcgaaaggcaacagaaaacctggggaacaatggctgtctttttaatgggagttgctcctattcctggtggtaacaacctcttcctgttgctcctttccgaatggaattgcctcagtgaagttgttgaagaagtgaggagggcgaaatatgcccatccttctacagtggggagaggcctggcgcatgaaagcaggcctttgtgtatgccgggctgggcccatgcaaacagggcacaatcaggctattgtttgtttgggaaaagctatggcatcctattgcaattatttatggaagaaaatatttgatgtttttggaagaggttaggtgtggggggtgatgagggagggaggaaagagactgggcttacctcttgtcccattcactccaaatctctcagtgcgtaggatagggtccatctggtccaaaggagagttttgtgtgactctgtgtgttggagtgttttcgaaatgcagagaaattcagagcttctctagctttggctagagaaggaacaatggaagtgagtcttattctacctaagtttgatgtggggcagcctgttctgtagttgccttccaagcccttcttctttctgatgctttcttggtaccattgcccacatgctgcctccaccctggatgaggtctagacctgttacattgattctcaactaattaaaagtcaatatggtaaaatatttgcagcattccttctccttccctgtgttcatttctgaagctcaacagtcttccatactcaagctgtggggaggtccctttctcctttgacaccagccattttgtgatctgccctttcaggccaccccagccaccctactttcccagtcttgcctctgcctacttcacctcttctctcgaacctcagaagcttctggagtcttcacagtggccctaatcatgggtctcatccttgttttcctgtctctttgaggttccagcagccagctttgcctcatcaggcctttctctgaaattcccatcaataactacaagatctgcccagtaccttgtgcatatcaggtctcaggaaattgtgagtttcttgtttcattaagcatttttctttccaggaatcatcattcatcgcattgccatatgtgtccagatcccccttttcagggagccagtaattcgaaagcacttgcctgtgttgaatatggtggaaaaaacaaatgtcaaccctagccggccatcactccccatcggcccaccccattctcttgtgccagtaggacttgcctgtgttttctttgggcagttcaaagttgggctcttgagaagttgcctgtaaattcaattgaagtgaccagatctcatccttacccactctgtagctgcagataataaacactggggacttcccttgtgcctgtgttttaatgtaaccttaagacttgatgctccctggagtgtaagaatatgaatagctactcgctgtggatattgcagttaattactccttcctgtcccatgtggtccccagaggaatatgagattgccacaaacatggcagctttctttggggaggtgggagagggagatgaatcttggggcaaggcacattctcataaccatgtggctccagaaagctgcctgactcagagaatggctataaatgcccggttgtatggatctgagatcctcaaagccaggttcattcacttatttattaatttaacaaacattaggcagctgtggtgctctgtctgctccagcagtgatcaagacagaaaagatttcttcaatgctgcgtgtggtggctcacacctgtaatcccagcactttgggaggccaagacaggcggatcacctgaggtcaggagttcaagaacagcctggccaacatggtgaaaccccgtctctactaaaaatacaaaattagctgggtgtggtggcccatgcttgtaatcccagctactcgggagtctgaagcaggagaatggcttgaacccgggaggcagaggttgcagtgagtggagatcatgccactgcactccagactgggcagcagagcgagaatctgtctcaaaaataataataataataataataataataataataatagtaagaatactggggtggggatggtaggatgcacagtaaagagaataataagctagtgatgagcatctaagaagaaaacacaaaacagtactgtcatcacaatgcaggagtgctgggttgggggccaggtgtggttgaggggtgctgtattacgctgggtagtcattgaggcctctgtgaaaaggtggcatttagactaagggagattggaaggtccagccatgggaagttcaggagaaaggataagaagaaaaagctgtcacatgggcacagactgatgaccagcaaggctggaacttggaagatgagggaaactgagagtgattgtcagctcaggctgctttgacaaattactgtagcctgggtggcttaaacaatagacattgcagcattccctctccctctctgtgttcatttctgaagttgaatagtcttccatactcaagctctggggagatccctttctcctttcacaccagacatttcgtgatttgccctttctgaccaccccagccctactttcccagtcttgcctctgcctacttcacctcttctctccagcgtcatggttggagaagcatattctcatggttctggatgctgaaagtccaaggtcaggtgtcaacaaggtctggttctagtgagggctctcttcctggtttgcaaacagctaccttctcactgtatcctcatatagtggtgggagagagcaagctgtggtgtctcttcactgattaaggacattaatccaattgtatcagggtctcacccttatgacctcatttgatcttaattgtctccttaacagccctaccttcaacagagtcacatgaggggttagggttcctacatatgaattggcagggtggaggtgggaggtggccggggatgagacacaattgatttcatagcgtcgagttataagatgggtcacagtattagatgggaccagagcagagagggtctgtaggccatggcaagagtgagaatttactcaatacacagtggaagttggggatgagtgagaagcacaagagtggcacactgatttctacaacagtcagtctagctgctgggtggagaaggggagaaggaggaatagtggaaaaagcagggagaccgcttaggaagctgctgggaccgtgcatatgagagatgttggtggcttgaaccagtgctgggtttctcagcattggcagtattgacgttttgggtgaaataattagttggggagtggcagggcggggggtaggggtgcagtcctgaaccagtgccaggtttctcagcattggcactgttggcattttgggtgagataattagttgtggggggctgtcctgtgtattgcaaaatgttcagcagcttcactagtctctacctgctagatgccagaagcccacccaccccgccccctagtcatgacaatcaaaaatgtatctagacattgacagatgttaacctgggattagggggtggggagaccaaaattgtaccctgttgagaaccactggaccagagtcatagcaatttgcagtggatagatttaggaatatttgaagacttgtaaaatatagcctgaagggaatggagactgggagagtgaaagatacctctgagacattttggcttggacagaacagggggtggaggcttccattcctgagctgcaaaggagtggggagggaggagcagtgtagtttgggaagtgtgtggtggagaaggcagatggggcaggagctctgtcttgcatctctcaggtcagaaatgcctcagacatccagggggggcaagctaagatggagttgaacacagcagtgtagggctcaggggacaggccaggaatggagagaaacatttggcactcatctacttgtagcttccctgtcgagaaaaatgaaatcatccaggggttttcaaattcagtggtctctggaccccttcacactgttaaaaatggaaaaccctgccactgtctacatgtttatgttgccccagtaatctatgcattgaaacctaatcaccatgtgatgatattaggagctggggcctttaggaagggattaaatcgtgagggtgggggacctttatgaatgagattgtgcctttataaaagagagctgctttgcctcttctgctagaaggtgccctccgtgaaccagaaagtggagccctcacaagacactgaatctgccagtgccttgatcttggacttcccagactctagaactgtaaggaataagtttctgttgtttaaaagctacctagtttaaggtgttttgttataggtgcccagacaggctaggacaaacgccaataagctttcgtttatgtgggttgtatccattgatacttgctgtatgaagaattaaaattaataactttaaaaagatttattgattcagaaacagtaacaaaacttaatatgcgttaacgtacttttatgttggataaaaactatatcccaccccagtatatgaatagagtggcattgttttatgtgtttaatctctggcttaacagaaggcaattggatgatcatacctgcttctatgtttattctgctgccaatatcacacagcttctggaaacttccacggcacacattcatgagacaataagagttaaaaaggtaaacagtgtcttagtagtgtatgaaaatagtttaatctcatagaccccctgaaaaagctgcagaatccttacgcgttcacaaaccacactttgagaactaaagatcaaggagtacagttttctcatttttatgctgttcagagtgtggttgaagttcagccatcactagtccttcacggatagttcataccccaagttgatggccttgtggaattgctgatgctattttcatatatatatatatataattctagcctttttctctggtcttataagagtcacatacgtaggtaatttcatatcctacaaatatgttctaaacagcagaatattccaggaaaccttaagtgataactgagttgaaagagtcatattttttaagcaatacaatttaaataatttttaaaggaaacatttctaaaggacgttttacattgcttgcattaaaaagaatataatgaacataatccaactttttctcaatactcagggtcatcactgtgaaagtaacttcattctatgataagataatgatgctcccaggtgggcaaggcagtttttcatctaaggtaattgagacaccttttaaaagcaaaagataaattcacagaccctcagtgtcattataaattacttggtataaagatacttaaatacctacagccttataaggcctaggtgtcaattttttacgcttgcagatcttttacaactgtaagttaaatgattttacacattaagtgcatataaaacaaaaagattcaaacccaaatattaatttaatgacatgggtaatattttgctaaaagtaaaccactgctcagaatgtgaataaactgacctcgaaggcctgagtacgtttgaattacggaacacctctctttgacatcacaattgaattttttctttaagtatcgcaaggccccagttcacggaagtaccacaacataaattggtcttcacttggtatgtgaacacatatttatatgttaaatgtgtcttttctttttggtgtacaacagctagagtaatgcagtttgcttgcaatgtgttttttatgtaaatgctgatgccgaatccacttggcagcactgagttacaagaaggttaagtagatgaactagaagatggataaacgaagatagataaaatgaagaaaaacaaaaatcaaggagaactcaggcgtccaagagtgtgtaaacaacttctggtgtgagacgcgctacattgcgctaaatggcctgtgcgcttctggtttttcccttcctctgttgattttttatagttgtcttttattttaaacacgcctcccccccccctttttaaactgattttaccatcactctctctagccctgcctccctagaattagctgcttcttacctcccttggatctggaacttaaatattaacgtgtatataagttaatagtaagtagaccgtgaatttagaagagtaaaacagaatcatgagtacgtagtcactgtggccccttttctgctggatttcaagttcgtaagcatttttggaagagagtcgaaggggaaggggtggcttgccagtcagttgagtgatgcgtgagggaggcgttaaatgtgcatgatgcactaaaatgcatgtttcgagatccagtatgactgctcttccatagatgatgaaaccaaggcagagaaataagatgtaactctcttaccttgattagtgatgagaatgggacagctttattcatgaaacccggaaaccactagcccattcttgggatgattgatatctgcaaggatcttcaggaatagagtacctggggctcaggagccaagactagaagtgttgaaaggtgagcaggaattagctgctggcctcagacgtggagagacacacgggtgtatgtgtgcacacacacacacaggcacatgtatattcatgatggcttcttaattcccactccaggccaactcatttccctttcccttccacaggtacttataccataaaaggtatatgaagtgctaaaatacttgtaggtatgttgtcaatatgagctactctgtaaatgataaataataattgactggtgagtctaggcaaggcaagtcaatgagattacaagaaaagagatgttaggccttcagaaagatggaaatttctctttgtccctgcagggactgttgcagagcattagagccaccctcaaacagttacccagtgagtctcctcaaagcaagtggcactgagatacaaccttcctacaggttttcaagtcatctcgtgtggtgcacagtcctcgccctacctcgaaggcccgggcgaagttttcctgagtgtgtatactcatctctttgtgttgtctctggcagggagcaagtgagtacaggattggagtaataggcatttttaggcttgagatggctttgtgtgtttggttaatgtcactacatttcctaggggataataaaagtctagcatgataaaagatctcgtcttacaaggtcccgatgtaaagtttggagcctaacttagaatttaaaataaaatacattttgacccattgtattgagagctggtataatttaatatagtgagcccctcggcttctggttggttgggttataaagcttcttattcattcgctcatccattaatgcatttctcctatgaggaagctttttcctttgagctgaacacacaaaattaatcgtgctcgaactctccaaattttgtgagttccctggtaactgactgtatggaagacagaaataaaaatcagaataaacttttattttctgaatcagaaagcagttgctccagcttttggtggtcacattgctaagatgtaaaaaacagaagttaggtgaaataaattaagaataattattttggagaaagagagggtagtgtttgactaaattagaaacattctctgagtcttagaagcgtgaatgatttaaatgaggttccagcatagtattgcatgtggtttctattttagagttttcccacttgaaaacaaactttgaggatttttattgaagtccatcagttttaacttactcaaagcttagcagccaccttttgcttttcttcccgttccccccacctcatgctgtgaagaaagtcatacaccattgtggtgttgattgaaacctttatttctccaggtctcctctcataaactgggctaagaaacacaaaggacatttgacacttcatgactacataagatgtgctgttcctctctctttctgtttgaaagtgacttggcagggtgaagttgagaaccccttggaaaggaggaagccgaaatgcaaacaaagttgaatcatgaagtgatgtcactctgaaccaattggagcagtggtgtcatgtgcctggcagctacttcaaatgcccacaaaacaggagtaatggtttaagctgtttccctcttcccctcccaccaccaatcagcagcagactgctagaggacagatgcaaaacagttattagaccaggcttagttagacatggaggatgcatcttaacaagttagtacctttttgcaaagcatgaagactaattcaaagtctattttctggttttgctctaccagtacggccaaaaccatttctttttaagtgagaagtggggatatggtcaggtttgattccagttgaagttgtgagctgcacagggctggtctgagcccagtggcatctttccaggtgtcagagccatgattttaagctcctgttaaattcacagtgcttagtaaccataacttcttggtttcatgatcataggggtttttgcatagctgccacccccattttctgtttgtgatccagtagttaaaactcccagaaaatatttctcaccctggtttaaataaacaaaacagccaccacaaaaacaaacaaaaacttggctaaccactattttcaggcatattctgagagagaaagagggggaaaaaaagactagacatcctaaaattaagcaacattatttttggaattgtgttgtttcttatactcagtcatttgtgaatgatgtggttcaaacaaaactgaaacaaaaatagtttttctcattaaaaatatgtttgtcgcatagccagcactcggaactagggagggtaacatggaagtattgtcattctcggggctgactggttgacagcagcctatacaggagtggagaatattgacagggctgcccgttctccccaggtcgaagagagcaaatgcacatccctgtgtgcacggccacctggttcctctcctcacttgctggtgagtattgaacggctcacataattaggcagaactcaggaactttcctccctatctctttcactcttctgaaatgccctttatgttttcctctgctctttcagtcccagtgccttttctctggtgcagcctcatggttcggtctcaccttcagcttttccttccctccaatacatcctgtaaattattgtcagacttcttcttatctaaataactcgtttaggtaaggtactcatatgttcaaaataccatggtggctccctgttctctgtgatgtgaagtcctaaccattagactcagctttcccccaggacaccttggcttatcttcttgctgctttccagaggcatgggccattaggctggttttctgaaggttctgccaaaaggctgggcccttgtctcccaccccactgctgttactcatgtgttctcccacttgctcggcattctttcccatgctttttccttgatcatcacttactagctaacatctattttttcctaaacactctgttgcagttgtagtctgcagtcactctcctaagacttgatcatctattacgctgtttcgttctttattttttaacttttcttcttcttttttttttttgaaacggattctcgctctgtcacccatgctggagtgtactggcacaatctcggctcactgcaacctctgccttccgggttcaagcgattctcctgcctcagcctccctagtagctgggattacaggcacgcgccatcacacctggctaatttttgtatttttagtagaatcggagtttcaccatgttggccaggaggtcaggtcgaactcctgacctcaagtgatccacctgccttgacctcccaaagtgctgggattacaggcatgagccaccatgcccggttgttttgttctttaattttacaaacttggcatagcttagaagaccatatacagtggcaccatatacagtggcaccatattagtggcaccatatacagttttccctgagaaaactggtacctcccaacagataccaaaatctgggaccaccccaacagataccaaaatccacagatgctcaagtcccttttataaaatggtgtgatatttgtgtatagcccatgctcatctttccgtatactttaaaccagggatccccaacccctgggccacagaccagtcccggtccatggcctgttaggaaccaggctgcacagcaggaggtgagtggcaggccaactagcattaactgcatgagctccgcctcctgtcagatcagcagaggtcctagattctcataggagtgagaaccctattgtgaactgaacatgcagggaatctcagtaatgcctgatgatctgaggtggaacagtttcatcccaaaaccatccctctcccccacccatctgtggaaaaattgtcttctacggaaccgatccctggtgccaaaaaggttggggaccactacgttagaccatctgtagattacttataacacctaatacaatgtaaatagttgttatcatgtattattagggaataatgacaaggagaaaagtccatacatgtttaatacacaagcatcctattttttttcctgaatatttttgatctgcagttggttgaatccatgggtgtggagccctcagatatggagggcatgctatactgatcacccctatgggtgtgaatgttgggcagatcctccagtgtcaccagccatgtggccttggtgacctttccatacttttcaatcagaatgatgatctccacctctcaggaaagttgtggggatgaaatggtatagtctgtgtgtgtagagttgttaggctggggcctgccatgttaaatgcccatgaagcaggtaattatggtagtagtggttgatatcttgaaatcagggggattcccaaatttctaccccaaatctggatgactgcatattgcgggagttcagtaaatatttgttgcactaatacttatgtgcatacgctgaaataatctaaatatttaaaaaccaaactaacggtaggactttcctcagggatttaacgtttgctgtagaagactgaatgatagaatatataagctgtatttttcttgtgattctacacattgtccatgttgcaacttaaatatttttggaatgcaatgtaaaagtgatttactgtcctataattgttttcctgaaagcaaaatgatatttaagtgaactgcaatgaaaaatgcaacgactgtaatttatcgttgaagggcattttcaaagtgtatagaatgactaaagcttaagtgtattaaatattctagaggaagacatatttaggctataaatctagacttcctttggaatttgtttcctttttctcagccaggtgtatgaagattttaagttcttaggcctcagtgggaagaagatttaaggttccaagagtacatttgtatctcttttaaattttctattgtttatcagtgacatatgtaaatgttttagggagctgtttactgtaacattacctactttagctctgtgcagttgtctggcaaccaatgtgataaagacagagggaagtgctgtattttgttgctgacaagtatatcttaaaagtgcaggtgcacctgaataggcaataaagtattaagagctgctcctggagcagtttgctctctgtgacgtgtgaaaagtctacggggtttataattggtctggccatacggctgcctaggattagactcttttcatatcccactaaacactctccttagaagcaagcacaaggagatagtttattttaaaatgtaattgctatgttactaagatttgaatttgagtaccgagaataaaccatatttctgtttagaggctggttggcttaaaattgtgtctaatccttcccctgccccccaactccgaatcagagaatgaataacaaataaacatgacaatgaagtctcatgctgttgttttcatatttgtatttaggagtttcagagcaaatgacttggaaaacaggcaaatccactgacataggcatttttagccaccttggaatccgaggagggattctgcactatgccctgtaacctcgttcacatgccgtttgaatgtataccatgaagaccccttagctcagggagctttgctctatttaagtaatgtttatattcttaatgaaccaaagaggaagtggtcatgggaaaagagccaggactagatttcattctaatgcttataaggagagttctaggaaaccctcagacttggtaaaccaaggcatttggagatactatgaattggtttaaaaggccatttaccacttcttttgtaattggccttttaaaccaactctcacttagctgattaaatgtggtcatttaaactgctagttaacaatcggaagtgcagtggcgcaatctcagctcactgcaacctctgccttccgggttcaagcgattctcctgcctcagcctcctgagtagctgggattacatgcgcacgccaccacacccggctaatttttgtatttttagtagagatggggtttcaccatgttggttaggctggtctcaaactcctgacgtcatgatccacctgcctcggcctcccaaagtgctgggattacaggcatgagccaccgcgcccggcctaagatttcttattgtggtattctgcagtggagaatgggagttggaaagaaatgttttctcccacacctgtcccgctcctgtctactgaaagctgattaatcagtcagatagtgagttcctattggtagtacgcctccaaaatttggaagaggggaggtggcgtgatgtgaaaaagcaaggctttagggagagattcccgctgggggcattcaccctctggtccagcgtgcctgttacagtgatcactccatagtggttttgcatgaacaagactgcccagtttgcttaggaagaaaacaaaggacataaggtagttctcatgtcttcccagcaccctaaatactcgggctaaacttccacagtcagaccgtcagcttcaggaagggctgctgttgggaactttttttttagtttgcagttagttcagctccagccaaaaacctacaaaaagccactgcaagccctctgcctgctcgtataagacaccttggttgggcccctgtgactgtccatccataggatggttggccattgactgcacagagaggtagggcaagataaaacgactcatttgtggatctgactccttgtacttctgtttggattcaaacagaggaagatagagtagtggccttgggaaaccgtggagagagaaaaggcatagtcagaatgttttcagaggagcgcagacttttcaaaacccctctcatcacgttcccactgaccttcagttccagtgctgtggccacagggtgtctgcaccccaacttctttgccaagaaattaatgatctgtgaagacacacagacatgaggcggacttactatttaaaggaatcctgaaacgaatatttttctgatacatatttatcctaatatatttgctgagcatggtttttttttttttttttttcctattttggagtttttgggttttttaagcctagggaatgcctaatatgtactgtggagtgcatttgttcatttatatcccagtgcattgtaaaatcgagcaattcagtgccttagaatcctttctgtgaacttgatgctacgtgaactacttgagaacaactactttcaagccctccgaagcactcagttacaactgtcggtctaattgcacattattctaattcattaaaaaagtccccaagggcttcttaggatactgctctatgttattagaagtccttccaaatagaaaaactttattaatttaaaaataaccgccaattcagacttcgattcaaacaaggcattttaccaagtccggctgaaagagcttcttaccacatctggcatgtagaatggcagaagactatttttgctagattccttgttgctgcagccgtttctgatgtccttttccccttcacacctttcgtgttacacatgtctgagatgacatgatgctaagtaaccaaagtactgctgcgatggaattgctctgatgtttttttccagagtgaaagctgctattactttaaaaaaaaaaaaacttgaggtttggtttctttccccctctatccgggtgttatacaaatatgtaattaagatgtttgggggttcagatgacaaacaaggagtctacttctaagaatgcatttgcaagccaaaagagtggtgaaccacttcagagtgcgggtctgtgggggatgatgtctgctttgcttcgttttgtggaataatttttaacatttctatttagcattcatgatactctaaatagaagcaggagaacactgtggctctcggatccaggagaggcaggccacgagggctcctgctgtttggggacagtctgtaactctaaatctttttatatgcagcaattatgaccttaaaaatgggtgactctaatactggcattcattgcctaaaaataattttaatgtgcaaatgccagagaccaggtcatctcagaaatggactagaattgaccactgctatgttttggtgaaacctgataaccttgcttttctccgtgtaccttgtttttcattgtaaaactatttaattatgaaaatgagagtgtgaaaggcaaagtatgattgaatttagggggcagttccatatagttgtaacaaactgattatcaaatgtccaccattagtatgttaaaatacggttttctaatactgagacaacagggatggagcagcctatccactgaagtcttgttgtttgtccctgctgtgtcccaacctggaatctctttcttcttccttcagcagacccttcgagatcagcttaagcttcactgccttagagaaactttcctgtctacctggactgtcttctagatttctagagcagtgttcctgcccttttcctttctaaatggggtgggagttctcagagaactcatctcctttatggctttatccatcacagccacacagataggttctgtctggaccatccttttccctgagctttcttctcctttgccatgtgttttcatttctgccagacactggcactggggaagcctcccatcgtctcagactcagggtgtgtgaaaaacaaacctgctttctggactctacagtttgtgcactagcctaagccgaaaatcttgaaatctgtcatcagtgactattgtagtccataggaatacccaagactgggtaatttataaagaaaagagggttagcttttttttttccggctcatggttcttcaggctgttcaagcatggttccaacatctgatcatcatctttttttttttttttttagatggagtctcattctgtcacccaggctggagtacagtggcgccatcttggctcactgcaacctcccacttctgggttcaagcaattctcctgcgtcagcctcccaagtagctaggattacaggtgtgcgccaccacacccagctaatttttgtatttttagtaaagatggggttttgccatgttggccaggctgatcttgaactcctgacctcaggtgatccccccaccctggcttcccaaagtgctgggattacaggtgtgaaccaccacgcccggccaggatctgatcattttctaggaggcctcagggagcttttattcatggcagaaggtgaagggggagcagttgtatcatggcaagaagagaaagagagacgccagatctcctggtagataactaacagagtgagaactcactctttactgtggggagggcaccaagcccttcataagggatccaccccatgacccaaacacctcccaccaggccccacctccaacaatgggaatcacatttcaacatgagatttggagggaacaaacattcaaactatatctacgaccaaattttcctaattcctttctacttaaatgctttcttttccatttatttcacccacatctgaccctaggatttcaacgtgttctaaaatgaatttcttgcacccattttcactttctctccaccagaatccatctcaccacccacctgccagtggcatactccttgcatagaccctgctctagcatgaatatagcccactgttatctgttgtagaacctcacgcccagcttcccaccctgtgtgacatcttcaccctcttgccctggcttgtgccatccacattccgatcttgatgactctggttctcttctctttgacggtggagggttgatcccttccttccccatgatcataaaaggtcatgccaacactcctaaaacaaaagatagattaataagagaaaaacctaacaaatttattatatgtgtgcatgggagtcatacaaaatatgaaaactcaagaaaatggccagatggttgatccttaaatgctttatttattggtgagaaggtattgggggtgtaggagtaaatgattttcagggaaaatgaatatttccctgagacagcaatttacttgtaaatgatgctctttagaatttgaacacgctccagaggcagaaattgtcttgtgaaaaagtctgtctgggtatggttgcattcctcagtcttgagctggtggatggcagggtgcaattgcaggccgtagtgttcctctttggggatctggtttctaggtgggtaagggaacttcagagaacagccttgtcctgtgctttgcgagagacaaaggatgaggaaggggggtcagggaccttgaggctgcttcagcatgtcaagagtgccatgtttgggacgcctcaacactggaaatagccttcattcctctgcttcttgggtctggatccttttctttagactccaagaaattcttccttttgccccaaactcacattgtttttgtcttctgtccctctacttctatgtaattctattattatgcacagattctgtgtgcccaaggagactgtaaactccaggagggcaggaattatgtcttaaaacactagcggttaaacagttaagaggtgtcttaaaacattcctgtagccccagctacactcttgggtgcaggaatcacaagtgccttattccccacagggtccccagcatattccaggagctcattatgtttttaaatgaatgacctactgaaggcaagagaccaggaaggaaagtttgtaaaagtttacattattagattacccctgagatgtgtaaccttctcacgagttagatttcttgaaccactgcccgggtattgtattcctactctaggagcttgaaggattaatgataatccttttacagatatattcacaagtttctgtgaatgtgaattaagtatgtagatcttgattgcctttcttgagtgcatggtttttttctagaaaaacaaatttaagttaggtgggacacctaataaagctctaggctcctttcttttcctcttttaagacacagttaattaccttatgctaagttggaatataggaattatcttccaaaactgtgtttgcttgctgtgtctacataaaaattgatacaaggtatgccatggtttatacaatttctggcacatttacctggtctctgttacaggtttgtgaaaccaatttttttattgtaaatagtacgttaccagcttaattgctttagaacctagacagtctatgtctgtgatagtaattacattctttcatgactttgtttggtaacctgaatgttgaactagctctacagatttaggtcatgtctgatgctagccattcctaggaaaaagtggtgaggactacattatgggcctttccccctagacttaaaactgtgaagaagtcattttgggttgaggtatcccctggtaccctctcctgaacttcaatagaataacatgatgtggtgaatgaaccatattagaaaaaccagccaatcagccaagattcttgtattgactcttctgatctccctctacctctcctttccccatctgccaaacaaagggtttggaacagttaaattctaaagtggtgtcattgatggctctcagtattctgtggactttcctggttgattcagtacttgtgattgacctggaccccctggtttggtccagccttagagcgggtttgcaggtagacaccttcctaatgtttgttccacgtaagcccccggagcacagtatttccatcagctattttgtggaagtgagcgattctcttttggttgtaaaccttcactatttcatgtgggtgacttgacaatggctccatttttgaatggcccattgatagttgtagtctaaaaatttccagagattacacaagggtttatttaaagggaatgggaatagggagaaggtataacctttccaaaacaatctttaaggcaattataagctgttaggaaatgtcatgtaataataacacagatacccaagcttatatcacataaatcattcattttgcatgtttttgacagggagatttattttccaggttaaaaacaaaaaagaaaaatcttaaaagcttaagcttttattgtttgctttttttattaaaaagtaatttggagccagtaacttaacctgtttttcataaacatgctatctagaggcagccaaaaaaatattcatgcttgcatagtcagggtcctcaaatgaacttatgtgttggatcatgataactctggtaattactcgaattacccttgttgagtaatagtatggaccctgaatacaagggtttgatttatgtggccagctctgtgctgctgggtttatgaggacttgccagatgtcatctcctaattaaaatccttctttacccttaatatcctctcctctgtccccaagaaattaatccattctattgctggagcatgtaacagctgatgttgaagttacaagtttacagcttgaactttgcctagactgtaccttttttgggaaagagtttgcaaagcttttaagcctgactcttgtctttagatcaccagcatcaccatggtgcctggcatcagtggagcctcagcaagtgtttatggtggaaacctcagaagctgtcactttctctggctgtaacagttgtcatctttgtttacagggaaaatgctcttgagaaaatggaggtcattaaacactccagcttcagcaatatcatcagagctttccgtcacgtgagttatctcacaaaagggtcagattctggtaaaaactcttgccttcacacttacttctgttttattttgccttatttgacatttcaccagaattgatccataggttcaataaggctccattctgttgggacaaatcaagctagaaagacactgaactctgggggttaccagaaatatctgaaagcaaagcagtgactgtgaggtgggaatctctctgagaatcctttgcagaaccatgtaacagctctgcatcactagacgagccaagcgaagtggtcctggatggttcagtaggctcaagcattgagggtccagagcatcctttgcccctggacatggaagggttttcattgggagatggcatttagggcatccttataaacgagcaggagtaaacctagcaataaaaaccaaacctctgccttcagaggtatatgctattacttctgcttaaaccgttgtcagagctaacagttttggttagggatttttgtgggtccagggcacgcccagacacccagatgcttctctatgtttgtaagatggcgagtgttgagatgtcttataggcttatattgagtgaaaaggaataggatcctttgtcagtagtaacttaggctttttaggtggccagggcaagagaacaccccccctacacacacacacacacacacacacacacacccctacacccacacacacccacccctacacccacacacacccacccctacacccacacaccttcccacacaaacctacacccacacaccttcccacacagacctacacccacacaccaggatttgaaggctctgctaagaggctacaacaactgtagcatacaactagcacacttgttgctattatgtgtaggggactagatggaaagagtgcagataggactacctaccattcacccctaccagcgaagtggaagcactcatcttctttcccttcttaccctttcaaagcaagttgttgagggatgaagaggagagtgactttaatcgtggctttaagtagagattttctttaggagtaattgtttctctcgacagagtggataggcttccatagttgtcttaataccttttgtccaccccaaggattgacccaggcaaggaggatgaaccctcctcaatttgggaaagttaaattttaggcacagcaggtcaaagagtagggaagagctgcagttgttggaaccaagtgacattgatttagtctggaaaggagtcacagaggaatcaaaagccagaccctcctggcagctttagatgtggttggggtctgggaataatgctggtcccaaaatcacctctggaactaactcctgtaaaatgaagcctctgcatccttcagtaacttacttaaaattttgttagggctgcattttcttcaaagccaagttctgaataagaagtatttgttttgggctctagccagattactgaagtattgttgagggagatttgctgtggaaggtgttgggggtacagggattgtgaagataatgtaaaatatttaacattttaaaaattttcagtaagttctctttccccaatgtcagcatgacttcttcattcatgttcttccatcactctccattcagttagaatctcaattgtgtaatatcagtggtagcgacaattatgaaattcgtccagtgaggaaaatccgcagagctagagcccaaaccagcaactttgtagtgaggatgaccccactggccggggagaaactgaactgatttttttttttctctctctctcagctttttattttgaaataattttagacttacaaaaaagttgaaaaagcatccaggcatggtggcttatacctataatcccagtgctctgggaaaccaagacaaatctcttaaagccaggagtttgagaccaagctgtgagactatctctacaaaaaaaaagaaattaagtagccagcagtggtggcacgtggctgtagtctcagctacttgggaggctgaggtgggaggatcgcatgagccaggagttccaggctgcagtgaactatgatcatgccactgcacaacagtcttggagacagattaagaccctgtctctttaaaaaaaaaaaaaaaaaaagtttgtaaaatatcacccagttttccctaacgttagcattttacataatctatacaccaattctcacagccaagaaattaacaatgacacaatactgttaaccatggactatttgaatttcaccagttttcccactaatatcctttttcagtcccaacatccttcattgtgtttacttactatatctagtcttctccagtctgtaaaaatgtgtctatctttgcttgtttttcatgaccttgatatttttgaatagtatggacaggttgttgcatagaatgctccaaattggttctaatgtttctcatcattaaactcatttttatacattttggggaagactactacaagattgacattgcatctcagtgcgtcacatctgtgtgatgtcagcatcttaccactgatgatctcttagccttgaacacttgattgaggtggtgcctgccaggtttctccagtgtaaattttctgcttttcgcattgttactgatatcttagggctgatactcacagtatgcagatgtctcgtttctcttttttcatatttcttttcttttttctttttttgagacagtcttgctctgttgcccaggcaggggagtgcagcctcagacttctgggtttgagcaatcctcccatctcagtttcccaagtagctagtgtgcaccatcactaattagtgccccaccagttttgtttgtttgtttttttgtttgggcagaatctcgctcagtcgccagactggagtgcagtggcgcaatctcggctcactgcaacctccaactccctggttcaagcagttctcctgcctcagcctcctcccaagtagctgggattacaggcaggcaccaccacacccagctaatttttgtatttttagtagagacggggtttcacatgttggccaggttggtcttgatctcctgaccgcccacctcggcctcccagagtgctgggattacaggcatgagctaccatgcctggccttcaccaatttttaaattttttgtagaaactcactatgttgcccagtctggtctcgaactcctggcctcccacctcagcctcccaaccacaactggccaaggtcctgtttctcatcacattgtcactcactgatcttgtcatgctttggtggagcttatctacaataattattactgccatgctttaatggcaattttctatcttattgtcatttattcattggaatttttacataggaaagacctgctccttctcaaactctaaacagtttcattcaccatacttttctccaggtaactttctgggtggctgaaagtgactttcaaagaatggagatatcttttcaatgttgagagagtggcagtctgctggttcccaagatgccttcttcacctagcattgagactctgcagaatgccttgaccacagttgtgatttggatctgttggcttgcaaagcccatttgagaatttacaaaatcattttcacggcctgagagtcttttaggtactgatttttttcatcccttctttactaacagactttatttagtagagtattattggacaggtttggggttcacctttatgagaaaaaacttagattttctaatttcagcttttttattttcttccatcagtgggacaaagttgacatcattgcctaaaagtaatttctgtgattatctgtgtatttcagttaaccatgttctttggactcactgtggtcttcagcagggatggtggccaaactatgtttagaaagataaaaattaaaatgacatctgcatccttcatgtaaacccataaaaaatagcacgtgaccctgaagatcctctgcctctcattccaggcattacaattgaaaatgctatctgggatgttaaaaactaaaactattctaggacttagtggaatattgatagttagggaatgctgtttgctttcttgaattttgaacctgttattgagaaggtagatgcgcctgtttaccccaggaaggctcctctttgaagacagtgcccctggagcacatgaccttttcatgcccttgcctgtcaagacttttccagtactctaaggtcaaagggcgttgggccaggctgatctaatcagggtattaaccttgccccactcatcttgatttattcctagatcccagttcccagagcatccctttagagcctcagaaatggaacaaaagacagctgaaataagcccgtggccaaaaggcactctgagcatgagggaagtaagcaggcttccctgtcactgctgaggctctgtcatccagccccagctgtcctcttgtgatcactcagcagacccgggaaaaattcaagaatttgttttttagtgtcagtgggagacgtggggatcctgcttttgctgggagagcttcagttgtctgagtccccactcaaccccaggctcctgccaaggccaccaagggcaggagcactggaaggctgactatggagtgaagaggccactgggtttcacaaacagcactgtcagccaaagctgtagcttgttagccatccaaaagaatcttgcacctgctgccagtgagcttacacctagatgacagctggagctgacactcattcagcccttactctatgccaggtactattctaaacacttgccatatactcagttgtcccacagatacaactatttatccccactttagagacaaaaaattgaggcacagaaaggttaagtaatttggccaaggaagtgcagctagtaaatggcagacctggggtttgaaccgaaatcagtgtgactctagagtacctactcttagaccctactctctactgcctctcattagaagtctcccccacctccctaccaccaccatcaccacccaccctcccagccacatatatgctcacactgggtggttcagatggctagaagtggcagctcaaccttgtgtgcctcggacacgaaaatattaggttcagacaccactcagacttcacattttcattagttttgggtagaggaatgagaataaatattcagcgagacagccttttctaactgcaagattgcattcctcttctttctagatgcagtggcaagaacagtaccctggatggtggagctggtagtggtagatgagatagagcagtcccttgattctgctttgtccccattaatgacagatctgagggcatccagaaggaatctccacaagcccagcctccacagtggctgcttcctctacatggtagagtggtgctcacctccactcctccatagatgccaagtcatctgtggtatagatgtggatgtctttgttcaaatggtccttgagtctttgctcagatgatccttggttcttcatttcacctgggaaagaaaataatttgcctgttgtcattttatccataatattaagaaaacttaatggcacaatctaagctttttaccatgttatttatcatgggattacttttttcaggtgtcttctgaacacgcagttgtcccaccaaactttgacactgcccttgtgattaatttttgcctacattaatcactctcccttgttttaattgcacattacattcttttctgtccttcccggacatctttgctagcacagtgagtgcagggaggactgtcacggactctctcccctcttgaatgggggcattccagcagagtgtgttacatgagctcagagcacatgatgtgagagcctcgtgatgaaagatactgcaaaaacagtgcgcactgttatcaaacctgactgccttcacatcttgctttctgtggtgcaaaataaggtttttatagtgtcctgtttcttctgttatcatctaaaccaatggggaacggtgagtaagtagtaatcttcagaaaagaagaaaagacagggaggagaaagtgtactggaggcctgctttaccattaagttgttaagatggagtctcactctgtcaccccggctggagcgcagtagtgcagtcgtggctcactgcaacctccaactcctgggttcatgcagtcctcctgcctcagcctcccaagtggctggggactacaggtgtatgccaccacaactggctaattatttatagagatggggtctcattttgttgtccaggcggggtttttgttttttgttttgttttttttttttttttgaggtggagtcttgctctgtcaccgaggttggagtgcagtggtgcaatctcagctcactgcagcctctccctcccaggttccagcaattctcctgcctcaacctcccgagtagactagctgggattacagctgcgtgccaccacgcctggctaacttttgtatttttagtagagacggggtttcaccatgttggccaggctggtctcaaactcctgacctcaggtgatccgcccgcctcggcctcccaaagtgctgggattacaggcgtgagacactgcgcctggccgtccaggctggtcttgacttcctttcgcttgtagcctcccgaagtgctggaattacaggcgtgagccaccgcatctggtctctaagttttttttgaaagtgtgtgtgtatgtgttgaaaaacaatcttactgccatcatattgaagttacctagtgcatttcttcttcagggtacgaagaaaaaagaaaagtatgtcctgtggttgatagaaatcagtaaaatggagccctgtacgaggaagtgctgatgagactccaactaactccatggagatgagctacaaaaaaaaatactgattgggttcaaatccttggcctgccatttactggctgtgcttccttggtcaaattacttaacctctctatgcctcaatgttctcatctctaaagtatggaaaataattgcatctgtgtgaaaactgagttactatacgtaaagtttttagaatagtacctgacatacagtaagtgctgaataagtatcagctagagagagagagagttagtttccagcagcctgtttctgtttggggtcacatgtggtctctgtccacctggctttttaggcctctcttacctgttccctgtttatccttgcctgccccagggaggagtttgagttggtacatcctgactgggtactctgcctgtggttagcaaatactctgcatgttgagtgctttcaaaatacagaaacaaacaacttgtggaggcattggaaaagtgtgtttgagaaacaagcagcctcaccatgaatgggagtttgtttccctttctcgtctttctggtcatctgctgcacgggcaggaggagctgtgggttgcttttcttccttggaacatggagcaccactctcccctgtgctgatacacttacaaagaagttcacctactccttggaaagttctggaaaaggggcttctacactgttggcctctcgaggagaacggtttttgtttctgtcttcctggaaaagaggtgactgctggcatcatctttctagataaactccttgctatgatgccattagaagcagtgttcttttgtgttttgcttttgtttttccctgtagacaggaataacattttgactagaaacttccctgatgtaataacgaagatggcctccttagaaagttccagaacagaccccttcacctctgtccccagaagcagaagtaggtgatgcactttcttggcaagccacataactaccatttctctacaatcgaagctcaaaaatctgtgcttgtatacgttcattttttgtttttacttctttacttcctttgataagacagaaacttctgtattaaaactgatttaactctgaggggctaagtgaacaacaatctgttgtcctatagaggtcaaggcagtgctcacaacaggatcattgtgctgctgtagttcagtttaggggacggggaatgtttataaaaacaaagttttgaaatgaggacagggaaaggctttgtttacctggggctctagacttaaggtactcattttgcctgcagaataatgaaatgcagagttgtaattagaaaaggttgatgtaattgatgtgttaacaatttttgaggtttttctctttccactttaggacagtcatgcaattatttttctgaaccaaaatcagaaccatcagtcgaaggctaaaacaggcctggggaaacactgtcttttggcaaagaaagacaaagatccttgttctctaggccagtgtgcatatgtgtgtaatgctttaaagaacaattttgacaagaactcttaggatgcaacttgtagagtgatttttaaggagatgcagtaggatttgtgcaagtattctgctatgagcctaagattttcaacatggaaatctagccatgcagtgactcgttcactttggcagtgtctatcttagtctgggggtgagcgtttgtagaaaatatttagagactcaagtacactcatttgaatttttgctgttagcaaataaatggcaatatgtgtaacgtggtgaatgggatgtaaagctgtctttatattaccacggttagaatttaattttgaaagttgcaagtcaaactgcttcctcttgcgtcattaagttgtgcctcttgtttgctcaccggcatgtgtgtccttgtgtcattttggttgctgtgaaattgctcttaccattctttcatccttcaacctgctgtgctacaatcctaacatgctgtttttgttgaaaatgcattcactctttttggcatcttttttccccagaaagttagaatattgggaattcattggtattagtgaaattcccacctaatgcagcagtttttttctcttacctgcataatagacgcagaacaaattaactctaaacggattagagctgtcaactgacagatactgtgcgagatactgaggaagcctcagagatgataccaataaacaggacagggccttctggtcgtgtttctacttctcttattggtttgtcttagcaattttgaattgcactgaaaacgaaatttcataggtacacgatacagtagttagttttaaaagtttttaaaatattaaaaaattgaaagtatttaaaatatttttaaaatattttaaaatctgctgtgtgagatagataggagacctagcttttcttccttcttaccttgatccatagagaaagcaaccctgaaagaagaaaaactcacccatttgagctttcttttgtttccactgagcaatacggaagaaattcaccgctggttataggtcttcagtgctttcttcagagtgggattgttttttgtttcaccataagtagtagtctattaaattaacagttgctagagaagaagctgcatctatatatgcagttctcttcttgtcaagcagtatattttcacgatagcaatgaaaaaattccatcctcaccagccgctgaaacatagtaatactgcagaaattcctgtgaactatgcgtttgctgcttccttttgtttgtttgttttcagagcagatgggcttgtttgctttttgcttaaacattaatcaaaaatcaatttatggctatgtaagtggcattagataattctcattctgactacagtaaataatatctatttgttcatgttagataagtctgggcggcagtggaatgtaaaatagaattacatgagatatgacatatggctatgtgttttataaattaatgcttttatgcatgtgggaggagaagtaatttagcttactgacaaaaagaaaagcaaaggaaattccagagaaagaacaggataccaagtctaaataaatttggaagacaaagagaatatcatagtttagttcaatcttttaaacaaattgtcacaatttatacgttgggataagagaaccatgagaaaaggtatattctaagtcctgaacatctttctataccctgaagatgtttttatagctcttctgctgactccctgccaaaaaaactatttacggtttggggtagggggcgtgtcatgccatacagctaaatacacttttttcctaatctaggaggcatgtctacttacaaataaattgcttaaactagttaggcttgtgtaaatgtaactgacatttccttgagatcagaaaaagttttgctgattaactatatttgtgtgtgtgtgtgtgtgtgtgtatttagagagaaggagggattttataattattacaatttgatttgaaatgtctagagaaagtgagagattatggaaattaccataaatgctccctttttcatagatttagatctgttaattgcaagaaatctttttttaagtgaatcaatgggaactttttatttcttccctaagattcatttagccttgaaaaggccaaaagttgaatgaagcttctaaatgccaatctttccctccttctgttaaagagtatgcttcaactataattacatttgcattgtttaaaatattagtaattctacagccagacctctgagatagctgagaaaccaaaaagtgaagttcaaagacatcatcaggcaccctctccacacacaacataccaggcccaccaaggagtttacatgagtgtttttgccttgttagccgtggaacgacctgggcagtacccaaaacttagcaaactcttcttgtaccttgtattcagtagacggtcagtagcaccgagagtagggagaagagtaaatatgtttctaatactttattcaatgtatgttgttaacagtgtagacactctgactttccttgtgaattgcgcctcagtatttagttttcatttaccctggatcagatagggcatgataacctttgaggggctttgtgcatatgtaatttggaatctgagtcagtcgggctgtgtctctcccaacttcccttctcatattcttctctctcctcctcctcccctccctcctcctcgcctccctcctcctccccctccctcttcctcccctccctcctcctcctcccctccttccttctcctgccccctcctcctccctcctcctccttccttctcctcctcccttcttcctccttcctcctccccctccttcctcctcctccccctcctctctcctcttctctcgtttctcttctctctcttctttctctcttctctctctaccattgctgtcagttgagatgggcctgtgcggcactttgtttgcagttgattggcaatcttctgttctactactgcatctgaatcatcacttgcttccaccagttctctgaatgtcttacctagtgatcctggtggggaaattacagtgattagtgttccaattcttgtttgcccataagtgtttcaaagtagtatttttaaaaactcttctaagacattctctcttctcatagtagatgcagtgaatcttaaaggtgccctaactaaaatttttgtgctataaaattggcagctttacaaaataaaaggttcgagatatgagcctgatcaaggctctgcatttgcaacaatatccttggtttgcctggccctgttatattttgctgttgtgatatgactcctgccagtgctatttccatttaacctttgtttttctaaaagacagtaataatttttcatttctagggagtctctgacatcagctaaaggaaagacacttttctttgactgtatatacatttctccccatttcattaatatcaaagttgctctttcaaatggcttataaaattttaaaattacaccagttgcataagcctgcataaaaagcagactcctacataagctgacaatgcatttgtaccgtggtgttgagcagttttaacatcctccgtgcctctgtgcttctgctagctactgctctgataaagttatcaaggtatcattggatgcattgaccaggatgaagacacaacagtatggccttattaaatttggaaataatgaacagacgagtagagaatttaggagcaatataggcaagcttaataggtctttactttggggcctgtaactccaactacatatggaagaatttaagtacaggaaaagttaagctcttttcccagtagttctgctgacaagttgggtgacttcgggatggttacctcttcatgataccacacggtgatggtaacagaggcactgtccagtctctggttcatgcacactggtcttctcaggggtccctgtataggtgacacagtggagaacagggcagtactgccagactcagggacccagttcatcgagaggggcagtgtttctcttatgctgccttaaaggcattggatgccttttggaaagccagtggacaactcctgcatccacccaagattaatgttaacagcttaaagaatcattgcaatcaagggaaattttgcaacactttgttgggatatttttaaataaatgtgtgaacaccttgttttaggcttgctgaaaatgacccaggaattccttgacccgggaatatagtgtatggctgccaattattatattccttcatcagacaaaggcggaacagttcactctttttcttttttttggacacaaattctcactccctcacccaggtcagagtgcagtagcatgatctcggctcactgcaacctctacctcctgggttcaagtgattctcatccctcagtttcccaagtagctgggatttcaggcacgtaccaccatgcctggctattatttgcatttttagtaaagacagggttttaccatgttggctaggctggtctcgaactcctgacctcaagtgatccttctgccttggactcccaaagtgctgggattaaggtatgagccaccttgcccggctaccggacagtccactctttacaggggggcgtcttggtataagtatggaaagctccgtagatgccgtgtcagtccataccctcaccaccttcttgaccctgtgccgataaactaagagatgtgggcagtgtaccatctggaaaggaaaaggctttggagccaggtagtcctgcctgcatttgaatctgctttctaccacttacttacatcaggttttccttgtctataaaatggaagtccttgtacccaccacctagaatggaagtgaggattaatccagaccaacgatgaagagtccagcatgcaggaaatgctcgtttataaccatggaagtttcgaggacttttgaaattcgatgacattaacctttgaggtgcattttagttggcttgtgtgatgaggcctttctacttctagttccagaatcgtctggatctacattatgtgggaatgtttattcccccctttactttcccaaaatttgctaaacattttcattgctatttgagttttttaggagacatactgagatgaagttagggatgtgaaaggtttactgaggataacaccaatgaaaggaagagaggaggaagatgatgggtgtggggagcggtttgaccaggactctgataggacagacactctgccagccctccgggagctcatttgcagagccccctgttagatggatataaccgggccctgggaccattgctgggctcagttactggccaggagctgcctaggaagagtgtgacctaggccaaaagttgaagtggaccctagaagagctagcagctggagggcatctgctagtgacactctggagctggacagcaagtcctttctgaaagaggatctgagctgagtatccctgtggtccagtatttcaagttggaacctctaggtttgaaaaatacatgttttgggtgagagtttgattattcttaaagggacatatctttcaaacatatggctgtggaagaggaaacttgtttttgacttgtaaaataccagcagagccttgcagtgatcacaacttatgtgaaatacagaccatcacccacagtttacgtgttcacactaaagtgccagtctctctatgggttttagagctgatttagatacatgcattgctaatacagtcagcccagccaagatagtgccatcctccgcaagcatccactaaggcatggagtcagcttccgtcattgttagatcagtacttgtttctttcccttgcttatttttcctaacctctctgaacctgctgtgttggaagcttaaggaacatcatcctctgttgggcagaattcttccatggccaccccagcattatgccccacaccatttgacttactcatttgtgaatgccaactcagaatgtattgctttgattcttgattaggatctcaacctctatttattgttaagactatcaccctttgattcccccccatcccattgtgtccttctaaaggcacagaatagaacatcttctgccagaaataacatacaaatttatcatcatacaactgtacaatatgcaaataacttgctagatgatattactgaagattctacatccaattaaaataaaaagagaaaacaccttaagataaccatactattaaaagatacagaagacaactggaataaatggaaagacataccacatttattagacaggaataatcatcattagcaagatggcaagatgtcagttctccgtaagtttttcaatttaatataaatccaaatacaacagatttttttcttttagttagattctgaggttatcattaaaacaaaaacaaacaaacaaaaaactgaacaagagcaaggagtccttaccaggtattaaaaacttccatagtgcctaaataattaaaatagtgagataccaatagatgaagagacagaccaatggaacagaatagaaagtccaaatgtagatgcaagtacctgtggaaatttagttattcgataaaggtagcttcacaaatcattgggactaagataaactcttgatttactggattggggcatgtaaattatggcccaatcatgccatgtttcttttctctggaaaagaaagtaaattaggttcatacattataccatgtaccaggctagactccaagtgaatccaaggtaaaagtgtaaacaaaactatgaaagtcctggaagaacacatagcgagttcctttttataaccttggagcagagaaagcctttctagtttcaactcaaaatccagaagccagaaaagaaaacattcataaaaattgaatttaaattacaaaaaaactttctgcatggccaaaaaccataagcaaagacagatgccaaactgagaaaaatatctgaaacttctatcacaaagagctaatctcccttgtttaaaaaaacaaagtaaaacagagctcctagaaattgttaaggaagaggctaacagttcaataggatttgggatgaagtattgaacagatagctcacagaagaagaaacacaaatagctaagcatagaaaaaaagtttgatttcactcatacgagaaatgcaaattaaaactacaccaagataccattttttcacttctcatattggaaaaaatccaaaatatttgataacacactctttggaaaacaaccccacatggctgggaggacggcagaatagcacatctatagaggagaatttggcaatatctctcaggttataaacacgtattctttgacccaccaatcttagagggggcatttaccccatagacttgcacacatgtgaaatgacagttgtgcagttgttcattgtagtgtttcaaatggcaaaagatgaaaatgtcccccaaattccatcactgagggaataagtaagttagggtgatagctcccaagcttattttctcttcagaatcacctcatgaagaaaatgaaggtctgtgtgatagtagctggcaggtgggcatggtggtgagggtggtgtttgagcggagacctgaatgaaggttgagaaggagccagccactcacagacacagaggaggccttcaggctgagagagcagagaaggaccctgtggcagagacaagctggaaacagcactgcttccatggtctggagactggaatatgtgggttctgcagacacctggggggggcaccacctggtaaatctgcctttcagctcttggttcttccagcaaaccatgccagctgtggctctgtagccatgtcctcggaagatggcagaggttgcaacgaggcctctctgaggtgctctgggagcacagaggagtcaggtggaacttgtggcatgttgccaagggaagaagtgatttttagacagaataggaatttgccaagaagagaagtcagaaaagcataactggcagaggaagcagcatacgttacaagtaactgcatgtgtacagggaatcactgagtgatggacaagggcttggcacttggtgggggggggtaccatgttaacatgttagcaagaaactaggtaggggtacttgacttgggggcagcagaagcaggtgtgagtgttggacaagacgagaactgagtgctgcaaatgtttggcaagacttgattgagtgcatattgtggacctgtgtctccactggagacacaaattagaatataacaccttgccctggtatgctcagggtctactgaggtggagaaacctgcaagtagagtcggagtacagtgttgaaaacaccatctgcaaccttaacacagtgctaccaaaaccgatttcggagcactcctgcaggaagtgggctggccagggcaagggaagccgtggagaacagtggcctctcccgggcaggcagggtaaggcctagaaagaataagctgagtgaaggtttgtgtgtggcccatccagggacctgcgacaggaacacagcggctgaggaacggatgcttggagaggagggggtgctttacatgccaggcgggcagggccggggtggggccagatgctggaggagagggctggccaaggggtggcagagaggccccccaggtggcaagtttgcaccctgttgcttcctgcaaggagcttttgtttacgttttcagcttggacagtctggctgtctggccaagagtgacaacgtgacttaccatcagagcgaagcaccaaagagcacataaatgaagtggagatccctcctgtgtccagcctccccctccccgtggccttctcctaccttcccagtcctccatcagtaccccggggccttgccagaatctcagaaagaatctctggactctggctcaggacctctgaggtgattatgcatctagaggcatccccaggtgctgcccaatttggggaagcagcacttcccgctggaagctgggaagtttcccctggctgggggtcctgtgaggatggagaggccagaatgaggaatgggttgtgagtcaagaccaaccagaaggggacttagcaatgtcagatgatagcctgggtgaactacatcctgtgtggaaaaggcaaggtgtaactgcttatttcttgtcaagtgagcctaatatcatcatgtttctttttatgcctgctcccaaactcagcccctcccagtgagatcacagctccaggaacttgcaaggaaagggactaacggggcatctgattcacccgtgtgcccttaatggcgtattgtgtgaataaagcaacaatttttagtacagggatttaaaacaacttctgcaaagacagaactaaaaattaatcttaaaaggtggagggttggggtggagggcaggaaagaggaggaactaaattgccattctctttggagactttctaaaacctaagacgaagaagaggagccgaattatggaaacaaaacctttgcggttttccacagaacaaaaatgatgtgaagctgcaagtcagcagttctggcgcaggggctccgggggacgcccgctccgccggctgtggtgtgcgcccttcctgctctcccctccgaggggctgaggctccttttgtctggcgcgcgcgccccaccccgccccgggcgagggaagagggagcgggcaccccgcgcccgcgccgccgccgtggaccaaggttgtttactactttccactccgaataacacgccaatcaccagggcccaccctccccgccggccaatcgctgcgttgggaaattccacctttccgcggggcccgggcagcgactggctggagtgtctgtcagtcaagtgggcatcccgcaaggatgcagcaggagtattagggaggcgatcaccagagcagaggaggagtaaccttccccataaacaagatgtgttccccccactaagaaagcgggtggagggtggaggagccaaaacacatcccagccccggggccccaccggagcgaagcgggccgagcgcagagtgcagagtcggggaatccctccctccgcctcccgccgtcgctgcagttgtaaacacgtttccctccatgtctgttttcccttctctctcaccgtggccattacgggctgctgtttacaaaaatcctgcaggcctttgacaccccgtcctcccttcccccggcatccctgcccttattctggctttcttctcttccatctcctggtgagcacagcatactgttctcaggcttgttttccttttattgctctccatgtgggacaggtcatgctttatcaacatgtaccattttctacaaatgccgcccttcctctttaaattgcttggatgggcagatcgattttgattagcaacactgcagcagaaacaaggtgcatctctggaaggactgggtggttttctcgttattgttgctggtttgggtcacatcggatgctattttaaattctgtgttttattccacgatgggtcttgaatcctttccctattcctaggtttgaaatatgtttcctccctttaaaaaaaagaaggggggcagtattgtgttgaaccaaatgtttttctaccttctcctgtgatctgaatcaggtttcccatttccagcagtacaatgtggttgtattcagtgtgataggggcgtagtggacatgaattatttgcgacagggctgcctggaagatgcggagcggagtttgcgtggcccggagcagctccagtgtctgaggcttctctgtgtcacaggctccaagcaggaagcgcaggcaaaatggcaaaatacagcatgtggcattcagttcaaaaatgcccttttttagaagtcggtattctaaatgacatccagtcttgcttagttttttaagagaaaggaaaaataatctatgaagatggtttggaatattttgtgaaaagccttttcagcataaaaaagatgatcttgagggtctggtttgcggagtggaggataagcctccctcctgcgattctgaattgctttttggtttgtaggaatttcaggaacatgttgcaaagccgtggccgcttgaaagggtcggtgccctgcgccccgtctcagcccctgcggcccctgaactttttcagtgatggggcacttggggagaagtgcggggagtggaggaggaggggaaggtgcattgcaaatagaaatgtaaggcgtggcctgggtggccaggatgtgccagagcagcctccagacctacttaaatcccaggaaaagtcctgcctcaagttaggcacaacatctgacttggatttctctctgtttttttctcttccagttgtctgtctgtgcgccctctcccacaaggaatagttttccacactgatggaattaatgcatatcgtggtattattggtggaatatgtttaacctttgtttcgtgatttgagaggaatggttcttgtgtatcgtgtggtgacagcaggttaaggagagtgtcagagctggtgcagagttttgccccggggccatgaggttctgggcatcatgactctcttatgaagttacaaaactgggcaagtgattgaaggcagaaagacactgtaataaagtgtgctccagtgatgtgtgctccggcttctctcccttactcatctgggccaggtgctttcgccacagtgagcctgggtgtcccctgcctgagatgagcacagtgatgtctatgcgaggttgtaggactcagtgaagtgccttagggattttgcctggcactctcctgggctcatgaggtgcctagggctgagacttccccttctctgtctggtaaatcatctctcccattctttcttctgcggcccttcatatgagctttgtaatttactcagggtggcagggtgaattcatcttttgctgggtttctgcatcacctgctcctttctggccaggtcagcctgttcattttttccatgccaacagcctctaagtgccagtaagtcacgtctgaacaaccaaagcatgtttccctgcgggagaatgccagggcaggcgggtctgggagccaagaggatttctcctgttcagataagtcgggggaatagaagagccctgtgacttgagacaagctttgagtgacacccagtgaatctcccatcactactttaatccctgccccagtgttctggttccccctttcctgcatgaggcagtacgagtaccctggcctggctttgggttctacacggtctgactttagcctgccttggtctttgttcccctctcactccctccacccctgccccccccaacacatgtggagtaccttaccctgccttcctagttctggaatggctgcccctgtgccaggccaccccattttctagaaccaccttcatacagcccctgcgcatcccactgtactatttccttgtttgtttttcctgtcaatcttgccttccgcgctaatgggacactgatgctgtatggtgatgtgttctcccacagtcatcttctcctcctgtggttggggtggggagctttctctgtgtccccccatgagagtgaggacagtctcatttaatggcaccatggtctgtggagccaggcaggcctgtgtgtctgactccacttcagcgctctcagccagcgtgggcacctcggacccagacagacgccccgagcctgtctttctggagaaggaagtagtaataccttttccttgagggagttatgaggattaactgtgcctggccctgaattcgtgccttgcaggtacttaggaagtgagttattacaagcagtgctttttatcatccatagatggagatgttatctatgctataggactgcagaaagaattacagagaattatgtagaatcactagggacttgattaatatttgtttacctttcccccacatggattgatgtcctttattatacttttgtacccccgcttggcaagcccttgacaaatattgatccaacaaaaaattagctctttaatgtatacgtttagaacctgttgctttgtcagtagtggtttttatgaaaatgaatgcttataggtcagacttctggaaaccctaatctgagggaattgggccaaataggaaagtgagccccttaaaggcagttgtctgaccagtacttggagcacaacaggttcttgctaaagcactgtgtttttaaaacagtggagttattaggttgaaattctgaatagcaagaaaaagaataatggaagtgctgccagccccgtgatgctggtgcagctggtcagtttgcagaaggaggccagttactagagcagagtggccgtagaggctgcaacacggtggccaaagcatgaagctgctgtatagtggcaaggtcacagtgatttccccgcagcctcggtttagagggagacggggtgtgctgagctgtgcctgcttctgtagaaggggccttctccaagtctgagtagccttaagccattaggactgctgagtctttctccacaaaaatatgtgggaggcctgcagggcaggtgctcaactaagctctggggctgcaaagatccagagccatgcccctccttggaggcaggtccttgtagacgaggacaatcgtagccttcctgattaaagcaggaattgtccaatcaggctatatgacgggcatcgtccatagtcttcaccaggggagcttttctgactatacatctctagccctgtggcttgagccagtcacttaatttcccctgagctttggtttcctcctcctggtagcagagagactatcagagtgaggggcagatgcaatagcatatgtaaaacacttagcgttgggcctggtgtttaactgcaataaatgttagctcatattttactgtgacatagatgctgtatgccttttgctgagtattaaagatactgagctgtagcatgcatacttgcatgaatcagtctgctaagttattttaagtttgcatttgaaaataaagggtggattgctatccaaatataaagaattggaaccaggctctaaaaggatgtttgctgttctttagcaaaataccattcttcttaagtttcattcaatcattccacaaaaatttaagcatctgttttgtcccaggcaggcactgtgcttgtaatggatgtgcaatagcaaacagaacacttgctttcagctcacacagagctgactcctgggcagagaatttcgacagtaaagaaatacaagtgtgatgaaggagaaaccctttggtactacctgctacatgttttaatatttaaatgttgacttagggaggtctttccatctaaaaataatgatttgccctttctcctgtaaatgacccctttctcttaagttttgggtgagagattttttttttttaaggaagaaagatattctacaatcgaatgtacaactgagataatgcttaggagagaatgtatactgggtttgtgccttggaagttgcttaggggaaacagttgtgtgcagttggaaagctgatgctttaaagaagcttctataaagtgaccccacaattaaactgttttgtgtacatctttatttatttatttatttattttttaattgagacagagtctcaccctttcgcccaagctggagtgcagtggtgcgatctcggctcattgcaacctccacctcccaggttcgagcaattcttctgcctcagcttcctgagtatctgagattacaggcatgtgccaccacacccggctaatttttgtattttcagtagagacggggttttgccatgttggccgggctggtcttgaactcctgacctcaagtgatccacccacctcggctttccaaagtgctgggattacaggcgtgagccaccacgcccagcctacgtctttaaaaataaatgtaaatacccaaggctcacagttccgttcttccatctagtctagcaccgtccagtggaagtttccaccatgatggactgttctgtggatgccctgtccagtacaggagccgctagccacatgtggctatggagcacttgaaatgtggctagtgctacggaggaactggattttggatttttttaaagttttaatttaaatttgaatagctacatgtggctaatggctactggacatcacagatctaacacaggattaactgacaaaattctttcctcttaaaaatatgtgtttattttgataaggataactgagacctgtacattccatttttcctgtcatatttagggctcataaagggggtggtatgcacgttttaaaaaatgcaacacaaccagttaaaccagctgtctaattgtacacatttcctggagctgttggtgttgattattagcaaatactaagtacttgtaatgacctaagaactataagacaagcaagtcgtcttctgtaactgagtatcagcggattcaagcgttaaggaaaatgattaagagaaaacaaccaaaaaagtcttaatggttctgtcaatcaagtggctatcaattcatggctattcaaaagcttttgtggctatgaaaataaactagattgaaaaaattctaaaacaaaattgaaacactcatttgagtttaaaattttagttgagttgatttttatttcttgttttggttcatttgtagtttccccccgcttcgttgtttcctcagatatggagaataaagcctggctggtcagtttcagtttttatttaaattcattttgtcttcattccttttaatctagcacagtcctgtgatgtattgggatcacagtgctctggggaaacattgaaatataaaaacattttcctgaaaacatttccagttatatttaattttcctccttgaatagaaaaatatttccaacttaatcctccctctcccctcttgaaatgaattgcatgctttggaaataacatcaatccacccaagtacacaaggacaatctcagccatttaatcgagatataaaggcttagagaactctgggcttcggaggcacagactccacctttcaggatgctaataaacgtggacgaggtctcgcctgggcttcctcctccattgttcagcgcagcaaaccagcacagcactccgtggccagggtttgcggggagaaatctctcactctgttttagtagcatcatcatccttatcagcaccctgcttttatttttgaacagccaaacttcctctttccaaacttcgtgtgacatctgggaccagctatgtttgaaggagtctgaacatgccacatagtggctcacgcttttaagggaggaaggccagtaagcctcctcaatggcagaattctactttcagtctaccctttggttctgttgtggttgttccttagaactttattctgctcattaggaagcccagcctccggggagggtttagcttctcatctaagcaagaagtaaaatgtcataatggaggaaaaaaaaaaaaaagtccaaactttttttggacttttagaaacacatccagtttgagctccactgagctatcattgcagttacaaagcccatgtatattgagatcggtgtaaaaattcagcatgtccacctgcataattatgaccagtgtattgaaagcacatttcatttagttttgcaacagccgatgaggtagattctaccaacattgttttacggaagaacaaatggaagcctggaaaaataaattgtctacctcacacacttcgcaggtggtaaacacaggatttgaactaagacatacttgattttaaagtgtttgcttttcctttgcactactgcatctgcgatgtttgcactcagacactctagaatatttggtgttgcatgtttttgccccaagaaagaacccattaaaatgaaactttccagttcgtaagctttgccctcaagaagggaaagaacttcttgcaaggtttctgaaacaaaaagaaaatgaaaagtaactttactgtatctgggttttctgattaaattacggtttttgcaagcttgtgcatttctcagtgtccagatagccaggatttttccttttaataaatatcactttaaaaaacaaacacacacattcttaaatgcatgattaactgtatagattgatttagttataagatgtcctagcctaaatataagaaggtgtatgtgttagaattaatttcttcaataaagagaaagaaattcaggaattgtggttctgttggtcttctgtactgtatatttttgtgcagccaaagcagcatgccttgcttcttggtttcatgaccacatgggtagtttcttgaagttttttcttttgagatggagtcttgctctgtcacccaggctggagtgcagtgacgcgatctcggctcactgcaaccttcacctcccgggttcaagcaattctcctgcctcagcctcccgagtagctggaattacaggcatgtgccaccatacctggctaatttttgtatttttagtagagacggggtttcgccatgttggccaggctggagtttcttgaagtattgactgatccttgactctgaactgtatgatcaaagacttttgaaatggcacaccgtttcttaacatttaggccaatttcagttgctcatatccaaaaataagtcatgattttcggagtcagtgcgcagcacttagtacaacaatccaaacccttgtacagaccatcctagtagaaatgtggatcttgagtatctcagcttcttagtagattttgaactccgtgaaagcaggagccaggcctctcacagcaagtctctccaatatgctcagtaaatatttgtcagatcgagcaatgaccagatgatgaaatacattaaagccttagggagaactgagactactgcaccagtttttgtgcactatcatgctggaaatctttccaacatgtattctgtacttctttgcttcttactccagtgaatataatttagtcatttctggccaacttgaggacatcagcgagcataaattgttgtattatgcataatacagtgataccctcaaggctgagtgggaggcagtttgccctctgctgaaggtttcttgtgcttattgtgttcttatggtttggttttaccatttttatgtctccatttctgtttaatagacttatttcagtaagaagagaaagccgtctccatcagcccctctgtaggtgattatttgccacttcctttttgctgtgagtgctttgaaaacagatttctaagcttgttagagttatgtgttaagagtaaataggcagtaagtgaaaccaagcttcttcctggtgcttgactaccccagaaatgtttatttgctgaatagttgagttctggaaaggtgaggtataaatgtgtgataaatttattcctttgcatgatttttttttctttttcttccctccctccctccctccatctatgtctctgtctttctctgaacatctctccgtctcagtctgtctctctcatgatagttgctggaataatttaaatgaatgtaactcatttacccacatcgaagcccaactcagtagtgaaaaaacaaatcttccaaatgaatgcactttccccttgatgtgctatatacaagaccttggcacacctagttcaatgacatagtattttagaagggcctccttacaccttcctctcagataaatatacatgcagggacattctgaagaagtttgttatcggtcttctcccctcctactattagctccgccctcctagtccttctctttcaccatgctgacccgcgtagggaggacccttacaccctctgcatgcagcgctggtgctccttagtgttcataaccccaacctccatggcctctctcgcagttctcaggttaggccctgcttctaggggacattagctttccaccctctactacatacttcctagttgttgcagcctttgcaagcaaaacttgttttcatttgggagacagcatggtctgacagagcctagatcctggggtgaagacattctgggtttgtatcccgtctttaccacctctgagcctctgatgctggacaagtcagcaagtctttgcaccttagtctcctttctgtaaaaaggagcttatggggatgtaatcagagaagccttagcatggctcttggtacaaggcacggaccaaatccatggtacgctcactcctttcctttcagtaatactgcctaaatagggcacatgtacctaaaaggattttgtacattccttgacagcagaattctcatcttctgttgcatatcccataatgctgggaacacaaaataaaaatggtagcttttcacattcacttttggcctcaattttttgttattccccaatgaggatcatttcatttggggctggtctccggaaaaaagtagatcaagcttttcagatgagatttgggtgaaaccctgacaaactcttttttattgccttccctaccacatagtggtggatcaggaaactgtagggcttatgatgctgggaaatttctgctaatgcaataaagatttttgctgttgaaagaatttgatctgttttatgtataacatgcagagagcagaagcatatattatctgtagcagatgatagagcagggtatatgggcaagttagaaaaacacagttctcactacatttgaagaaaaaggacaaggagttgtcacaaggatccaggagagtcgcacataattttctgtcgtgcattttgttgactgttcctctttgcatccttcaaccatcttaacttcccacttgcacctcgctggaagacaaatctaagctaaattaaatgctaggcaatatgtcagaatggaaagggccctcaacttgggatgcccggttctctaccagcctgaataaactccagcaacagtatttctctaggaatcatctgtaaaaagtagaggtttgtcatatctctaaactagggattcaccttatttattaagctatcagtgactttatcttgaggtgcacggcttttagtaactctggttcaagtgcaaggaatgcaaagttaagtgtatcattggaggtgggatttttgagtttgtcagtcatttattgatttgcatgtatccttatagttcaaaggtctttttctcaacttagttgatgatcatgctgtaagttgttttcttttgctttatcaacttttaaaaacgtttattaacttttaaatttgaaataatttcagacttgcataaaggttacaaagagtaccaggagttctggaacaccctccacccagcttccacagatgttaacatcttacataaccgtaatacggttatcaaaacagtgttcactccatactccagtgctgttaatctccagactgaattcggatttcactattttcccactgatgtccctttttttggttccagatccaagagacgatcctacctggcatttattgtgttcagtttttctaattctgggacgttttcctgggttttctttagtcattcacgaagttcgcacttttggagaacatggggccagttattttgtagaatatctttctgttagagtttgtggatgtttcctcctgattaaatttggggggtacatttttaacttggagatcacagaggtgctgctgtttgtgtctttgcgcatcctgtcaggagatgcgtgatgtttcctttcctggtgctgttagctttgatcccttagttaaggtggtctctgtggcttcctccattatcattactatttttctctttgtaattaggaagaatcttttggaggtagatacttgagactatctaaacaagcattctgttcctcattattctttcacccactaattttaacatccattactgtgatgtttgccaaatggtgattttctatttctgttttctacacttagtaattggattctactctcaggattttatgtattttttaacagtgagggacataaactttttaactagcagtggcaagtccacttttatttgggaggacaattactagtcacatgaagaagaaaaaatatgcagaagcttaagaaatcccacatatgaatgttatttgaaatgttcttgccctttctccctacaaaggaggtgaagaagatgacaggagatgttaattgccaaaatagtctcatagttttggtcctggctgcaaatctctcgtttttgatactcaagagaatgctattggggaactgactctgaagcacagcccagatgcttgagatgggttgggaaggtttacatcaacaccatgaatttaatttatcatgtgacattttatttctgagtttttaaagctgtaattaaaagaagtgttcaaagtgttgctttcctcttttagaataaacgtggctgggtgtggtgcctcatgcctgttatcccagcactttgggaggccataggcaagaggattgcttgagccaggagtttgggaccagcttgggcaacatagggaaaccacatcactacaaaaaaaaaaattagcctgtcatggtagcatgcacctgtggtcccacttacttgggaggctgaggtgggaggatcacctgagttcaggaggtcaaagctgcagtgaggtgtgatcatgcccctgctctccagcctggacaacagagcaagacactgtctcaaataaataggcaaacattaccaacatggcaaacaagttggaggaggccccctatttaattaaatttcagcagtcccaaatctaattggtatgaagaaatcattattcagaattttccatcactgaaatactaaaatcacttgttgtttgagacatcttggcctgtcacccaggctggagtgcagtgttgctctcatagctcactggagcaggagcctcaacctcccaggtttaagttaatgctcccacctcagcctcctgagtaactgccactacaggcgtgtgccaccatgcccagctaattttttaatttttcgtagagatggggtctgtgttgcccaggtccctcttgaactcctggcctcaagctatcttctccagtcggcctcccaaagggctgtgattacaggcgggagccacagcgctcagcctaaaaataactctttagccaaaagaaagttttaaaaaattgtctgttgtattctttgattttactctatgtggtcttttctattatttttaaaataaaaaagatttatactcctcaagtgtaacattttatcaaatctcatgcttctgtttgatgaaaccgaatggctaaattttttaaatatcatgcaatccatcccagtttgtaattttattatggccctcacacaagagcgtgcaagctatactaagcttcctgtggccctcgtttttcctcactgatatttgtaactcattccaaattaaattttaggagtctgaaatgtagctgttatatttgggagatgtgaagaaaagaatcgtaggcatctcagtaggctaggtatcagatcacacatgcttgctggaccaaagaggactccttacagtaggatacatgattctgagttagtttgtgtactaagtatatactatatagcttttgaaggggagacgggcacagaattcacaatatcatgcactaagggttattttgtgtttgcagtttccagatgaatgttttaaagttggctgcagaatacagcgagataggtaaaatctatttgagtattacttacagaccccaaaggatatcccaaaggatatgttggactaattcctaaaatatcctgtaagtcattgcaggtacaggcgtggatctgggtttggaaacgccgcctggatcgctggctgggctcctgcagccgccaaggaggggctggctggaggtggggctcggcgtgcatagcggccacgtgactgcgccccggccacgcccaccgtccctcacgtggtcccaggccacgctgggcttcggcatgtgctaaagtggatagaaaagggagtggggcccgggcgtggctttgtggtttgggaagatatgaactccttggggtttttttctcttttaattctttaattttgatatttggaaatgcgtaaaaggtttttcatttgtccttgaccacgtggtccaaacctcaatttccctagcagaacgcggtttcgatcactggtggatccgtctcacagcaccagtcatgctgcctcgctgggaagtggagggctcaggattcccgtggttcacgatccattttatgttggaaggaaatcattttgaactatctcagtacacaccctagtgtatctttaaacctaattgagtgttgatggaaaatctgcggtccgagaaccgtaagaaaagggggctcccacctcccgctctggggtcgccacttgcctcgcaggcaggaggaggctcccagagtagatacaacttgcccgtcacccggatgggttggtagtgcacatatgcacggggcgcagtttaaaatgaaagtaaaagatgcaaatgtgtttgcaaaagaaaaattaacataggatacgtgcgggcgttctcagttgaactcggtcttactgttccacgcgagcaccccatgactcagagcccaaatctcagcggaacagcccaggacgctcctgccgtccacaggaagacgcctctgtctctgtcccccgccgccaccacacagatgcacgtactctcttcacttccgtgtacccagtaaatgcagatcctgatttaaatctgcagcatgctgctttcttcccattgcatgtgggaagcttcaggttctcttcggtttattttctcatcacctttattaaaatgcagtaaagcaaggagtatattaatgcgggcctctgcaaatagagggaatttattgaaaagcagaatggcttgaaagattgaacttcatcttaaaaatcagaaacagactcttgttattaatagctttagaaacgaaaatctaacttctgataaattatttcagaggagtggttcaaacgtgtagtagatagctctgcctggtcatcaattatagtgacgtccttgcatcagctccagaaactcagaatattcatgagctttccagtctgactcagaccttcaggagccatgaaattttcctgttgggatgagaggaagcgctggcggtcgtttcggcagcttaatgaaaccagaaatagataagcacgagtgaggggtgatgtccgcttgtttgctcccatcatgttgtttttaatgtgtgaaagtgaaagttttaaaagtcatactaaatgtgtgatcctttttagaattcactgggtacgggtacgtggaggaagtgtttttgtttttgtgaatttgtttaaacaaatgactgaggctttgttttccactctgtctggccaagcaccattgctacacttttttaaattcatgacatcctgagcagtgaagctgttcttcagcccgcctctccatttgtgactggaagacaaggaggcagacaccaatggcgcctctcacaatggaggtttatttttttttaatctaacggagggattgtagatggtgtaaaacttccttgtgccaggagagaaagggggagagagagagagagagagagagagagagaaataacccattctaaacaactttaggaatagatgatccgtaggcatcaactttgcgcagcaacaaaagccactttctgaacctcgttctgtgaagttttaaaacaaattgggtttgtttaattaaaatatttcttaaaggcaaaaagcactgagctaatttttaagaattttaagttatatattaatatgagtagtgatttataattttctgttgaaatacataaattcgagaagccccacccctaccacttgccagtcttgagtccccacggctcctttgcctaggtctaaagtcactgcttgcacactcctgccttgcatatgccttgccatcgtgtgggcctcttggctggaagtgttcttgtcctcccgttaggtatcttttatgacgtgaatccttacctctaattattatctgtgtgtacatctcatcacctgcatctgactgtgtgccttgtgtatgtctcttagccctcacaattgcctgacatgccttacaaacgggtagaccaagtgttaaatgaacaaatatttaataagaacttaaaagctttttgactttatatatttttaaagccattgtgattaaacactatgtttgatgtggtgctaattctgtgctttatcaactgtgtgaattgtagtatttttaaagtaggaataattgagaaatattttgaagttaggttaagcatagcagtaaagtttccactttttaaaatagccaaatccaggccaggcgcagtggctcgtgtctccaatgtcagcactttgggaggccagggcgggcagatcgcttgaggtcgggagttcgagactagcctggccaacgtgacgaaaccccgtctctgctaaaaatacaaaaattagatggttgtggtggtgcatgcctgtaatcccagctactcagagaagtgtttgaacccgggagttgggggttgcagtgagttgagatttcaccactgcactccagctggggcaaaagaatgagtgaaactctgtctccaaaaaaaaatcagagcgtggtggtgcacacctgtagtcccagatacttgggaggctgagatggaggtcaaggcttcagtgagccatgatggcaccactgcactccagcctggacaacagagtaagaccttgtctccaaaaaaaaaaaaaaaaaaaaaaaagccaaatctgttgggtttttttttttggggggggggtcctttagaatggccctgacagatctttaaggcatggaaatgagccttatgcaagctcctggcaatcagtatgtgagttctgtctccttggcaagatacagcctcttagaccctcagtctggggaaataatgctgatttctcctacgagttacgagaattacgctagaaaactctgtggcgcatacaggtgccctgtagcctgttggttagaagcactgaccctgaagtcaggtcgcccaggttggaattccagctctgccttcttcaagctgtgtgactctgggaagtcacacacactctctctttgtgcctcaggctctggttctgaagatgggaacggcaggccctccctctttggcttgttgcacagatgaaatctgacagcgtatgccaagcgcttagcacgggtagcagtgagtgccccgtaaatgttaggtaccttcctactactactaaacattcattcttcccttccctgctagtacctgcagctctgactcatctcacacccttgagagaggattatcttcattaaaaagtttttggtctgcccagaagcaagtgttacctgtgagagagctgggcttgtgcataggttagattatttctttgggttattcctggggaaacctgcaaagaaatgcagccagaggcctctggttcattttactgctcatctcctaaaagtggtttctcagatttttatcctttttttctctttttcgaggaaggggcaaggaaatattttttcatattattcttgtcatcgtctatttatttaataacagttgactgttgaaacataggaaagtacttatccgccaggaaactcccttctattattggacttacttgctttccatttatatgttgtctaattccaaagagatttcgagacagctttcaattaaaaaaaacaaacaacaacaacaacaaaaaaaaacaccacataccgcatgggtattacacaggacctgtatggtcaaattggcaacgaccacaccacatgagaaggaagattattcttcctggaacctggctcccttgagattcttttttttttttttttttagacggcgtttcgcccttgttgcccaggctggagtgcaatggcacgatctccggctcaccgcaacctccacctctcgggttcaagcgattctcctgcctcagcctcccgagtagctgggattacaggcatgtgccaccacactcggctaattttgtgtttttagtagagatggggtttctccatgttggtcagggtggtctcgaactcccatcctcaggtgatccacgcgcctcaccctcccaaagtgctgggattacaggcatgaaccaccgcactcccttgaggttcttgtaagccaaggcagaagaagagacatcttaaagtctgtatgtgcacacctgcctccccccattttatatacaattcaagggctttgcttttggaaagtttgcctatgtagtcgtccagggctaaattaacacctgtctctatctgtgtgtaaggctctctgggaggagctgtgaggcaaataaaaataaggaatggtgtcccgcaaggagcttacaatgtgtgcattacaagtatatactgagcatggccctgggaacacagtgaaaaaacaggattcctgccctagtacagtgtacactagtggaagagagagaggcagtaaacctaaaagtaagtcttttaaaaactgtggtaaaatgcacataacataaaatttaccatccaaccgtttttatgtgtacagttcagtgacagtaagaacattcacattgttttgcagccgtgaccatcatttatattcagaactcttttcatctcgcacaactgaagttgtacctattaaacagtaactcctcattctctcttccacctaggccctggccaaaaacaaaaataagtctttgattgtaaacacgatcagtgctttgaaggagatgggaaggatgttatcataaaatgatggggctgcaggaatggcacctactcagagagggcggtcaggagagacctcttgggaatgatgacatccagcaggcaggtcattaaggcatctctaggcaggtccagagtgcaaggaggcataagccaggcaggtggaacagcgtgtgtgaaggcccagagtcaggaaatggtctgcttccttccaaggaaaagaaaacagccagtgtggttggagcaggggctaggagagaaaagatgtgcatgtgtgtgtgtgtttgtgtatccccatcatgatttagtactgtcagcgcttctgtgttctgaacctggagtacaggcagacacagccgcatcccagaagctcaagagtgcccataccaggaaattacagaaatctttgccaaatggatgaatgaatgcaacttccttgatacagggtcagagaggggaaatctgagaaaagcaggtgggcaatgtactcctgacatactcccttccgttgcaatggccttgagtgatggagcaagagtgaaggaatgttcccatggcactggcaccaggatgactttttgtgaagcagagcagttggtcttagatagtggaggtgcgggaggcatgagaactgggcagtctgacggctgcaccagccagttggctgtcctttccacctccatgcccaggagctggcccagggcgcgcatgcacaaagccagtgctcttttcaatcagaaaacagcctgcgtatgttcttgcttgcaactcagatatccagcccactgatccaggaagagattcctttgacctgggaagtcataatggcagatatttagacccagctctcaagcaagcctccaagttgttccggtgaacccgtaactttgagtaacctctgattgaaccagagagtaggaactaggtgcagaaccttgttgaatagaattgtttagcatcgtccatttgttagagcatttcaggatgcctgtcctaaaatttggtatcataatggtatttacctctcactcacctccatctcagcccagtaattaataacaagggacttgcttcttcacctgtttctttattggttgtaggaagtcttttccttaccacagaggaaggagcttctggatccctttgctacgtccagagagttttcatctaatctgggtgtattagtccattttcacactgctgataaagacatactcaagactgggcaatttacaaaagaaagaagtttattggactcacagtttcatgtgactggagaggcctcaaaatcatggcggaaagtgaaaggtacatctcacatggcagcagccaagagaagaagagcttgtgcagggaaacttccattttaaaaaccatcagatcttgtgagacatattaactaataacagcaagggaaaaacccaccccatgattcagttagctcccggcgggtccctcccacaacatgtgggaattataggagctacaagatgagatttgggtggggacacagagccaaaccatatcactgtgtaaaagttgaataaagttatttaggagcacattgtattgggagtttgtttgtttgttgaagagccaagtaaagtcattggaagcatgggaaacttttttccctgtctaaaaggaactccttcctagtggaagttgaaagctttcttggcagcctcagcccccaccctacctccaccaccccagtgggtacctgcatcctgaagacccttcacaatagcatctgaactatactgggccttcaaatgatgtcttgggtaaacccatgtccaacctgcactaaatgaagattattttcgagcgaatggattgaagaacagtgctgaaaaactagaatttgtaatattttcatttgagcagaggtgaaatttgaaatattttagaatcttgtcttatgattttttttctttctttgccacatagccctcccctggaaattaaatctgtggattactagtatatgaactgatcagagacatggcttggggtctccccatttacccacttcccagcacgttataatccactggacacctccaaggatgagagaccagcgggtcataatgcgagactggacatctctcctaccccatgtacacttcagctgagcaggcagaattagcagagtcaggactagaagttcagtctagggatcaaataataatagtagctaatgtttaaagagtacctaagatccgccaggagacatactcagtatagttccgtggtttgccacatttcatcttataccagtagcacaggtgaaatttgtcttatgtgtatactgaggaaaacaagtccctctgatacacagcagccaataaatgacaaagctgggatagaaacttacttcattctaacccgagagtccctgttcttgcatgggcacagcctgccatccccatgctctgcctcctaagcagaggatgaacttaagcatcttaaaattttaaacattgactttccctaaaaccaattaaaaaaaaaaacaaaacagacagacagacatgacttgtgcccttaaaaatgcagccaggctggcatataaatgggcgtaggctgtttctaaattttttgctttaaattttgccagcatagcttctggactggtagttttgtttgctttttaatatatttttgacactgtgtacagaggaatgctacctcgcgtcatcatgtcctcctccctgaaggcaagccaaggatgtcaaggggccacttcaggggatgtgcaccctgaaggtaaagctgctccagtgggaggggttggggtaaatgacaatgttagcagctggtaaatttttttacatgggatatctcacaagacttattgatgcatgttatacgtaataacctgaggcacatcaacattttccactttttcctattctttctgtattttcactgatactttttttcaaaaaaatctccaataagtttaggatcagcttcaagatttctctttaggtaaatagatttgtatttttgatggccatcctagtccagtgtaaagatatggacaagaaaccccacataaaggaagcaagatcgctggctgctttctctaggtagcttgagttgtatactaatttgtagattatttctcttcatcgaaaaaacaaaacattctgcagagggcagtcatgtgtccgctgtgcctctgctcctgtgtgcaccataaaacttgaaagtgagccagaatttgaaaatatcggattgggatgtgatttctttaagcctctggctaatttaatataaagtgtttacacttcatttttctggcagtggattttctatgtaggtggtggaagatttcctgtaagttttgcaagttccagggcaaagagagttgcaatatgcaatatctttctgtggtcacaccaacagaaagggcgatttcttaacctgctgcagttaccatgtgtgtaggtggatgctggctattacagatggtatcctttcaaccctcaaaattgttgcaagttcacaggtatgttaatgaaaatgaataagtggcatttttaggaattccaaatactgagtcttggaagtagataatcttttccctaaatgtatgctccggtcagaactgctgcctaccacacctcgtgggtgaaacagatatttcgagcatgactgagcttattaagagccctgcggcgcttcctctgccgggggtttagaaatttcaaaggatgggggttgagggagggaggagttatgggcatgtgatgtggacagggcgggcaggaggatggaagtaacaggtccaaaatgtatctttggtggcccggcagagctcttgcatggggtgagaatggtaatttaggaagagcaagtcttcccatctgtgaagcagaagaaaaaagtggacttaaggagaagttcgggtgctgtttatttagataggagtaaggagagtgcagttggggaaaagcacttcagaggctttacttagactagcagaagtctgtttggcagggtgggaagcaagtgcagttgggagaaaaacgttttcaataggcagtttcagaattggaaattggaggagggcagtccatttcaacatttccaacagtattaaagaaaatttgcgggttgtttgtcaaaaggggtcatatgctttaaagattgagagatcttttcggtgaagtaggggagctggggacatcgtgatgtgacaagagccgtgggctcagaggctggggacctgggtgtttaacccaactcttgtgagtggtgtggctttcatagctttggttctctggtcttcactttatctgccaagtgaagacatttgactggatgtcgtgatcttgagttgctttcagctccagaattcgaagaccccttccattgggcattcatctaatttcaaagatgctccctggctccagctctgcagtgaagcagaacaaactgatacagcctagcttgggggtggggagtcggccctccttttcccctcccttcccaggtcctctgggtgattgggggaaactgagaagccgttctcttctccagagcactccatttaacaagcattgcagagcctggctcgtgctgcagtgaacaaatgctgacttcagcctttaccctgggtttcaggtcacactgattgtttgcaaaacatgttctttttttgtcacttgccagtacttgttctctgtgagtaaaacacaaacacatcctcagggatgttgcacaccagtttgcagcctgcagcttctgccctctggcctgcccaggtcctcggctccgggacgaggatgctccgggatttcgggagacagcagttgttttgacatgaatctcaaagttcctacaaagcttatttctttgaagaaggccaaaaaaaaaatgaaacattttcagatctttgttttcagattattcaagtccagaatgttggataagatttttgaagaagagatttatgcttgagattccttttagtttctttctttcttttcttttcttttcttttttttttttttttaggtgacttggccagtttgggtttttacggtgttcagggaaagggttaagaagttaatttgggaagtacagtcatgtgttgtacaagttgctgtctactgatcccttcattgagcaagtaaacttcacacattctcgtgtctgcaaagcatgtggatgcatgggcagttatgtgtatgaactttttttttttttgagaatggctttagtgttcagaccaaggatggaatgaaagatcacgtgtgctttccactgtagagctgccctgcttgttttgattttatagttattctaagtgttaagttccttcatctttcaaagcaaattcctttgatccctgaaaatcagctaatgtttgggaggcaattaaaagatgaggctgtggggttggggtgaaggcttccccagcaggaagagaggagaagcccactggatctgggagcacggtgctaggactctctaagcgtgacctccttcagtttggcccagagtggtcagatagtttgccggggcataggatggatgacaggcctcatacgcatcacgtctgaagggaaagcccttgaattttccacgctactttttagtaacagtaggctttgtcataattggcttcatgttccagctttcctaaaactgtaagtgatgttgggtgggccagcagcaaaataattcactttacaatttgcatgatagtctggaatgaaccgaatacctaaaaccaggaaataatagtagatatttaatggtttggggatcaaataagaatttactcccagatgtttcctaattaattggaaaaagcagaaggttgctggaaggccatctccattgggcatttacaggtgaaattcactcttcaactaggattttactcatgggatgcctgtgttcttcatttgaacccaattttacctatcatctacaaaaaaagaaaactattaagagttaaaaaaaaaaaaagagagagagagtcttgaactttgaaatccttcatccacgttttataaagtgtggggtcagattttttccctagttgaaattgaggaaatgagagttgccaatatgattggatttgtactgccaagatggggttttagcacttctaatgcattctggcaaggctggtatacttgtatcaagtgcacagccccactaccaccacctctaccacccacaaaaataaaaactagcaaaataaaatatgagccaacagaattctgtgggaatggcaagtgttttgtttttgtttttagtagtaatctttgcgagaacattccaaagatgatagttttacatttgtatgtttttttccgaggcacttttgaatcatcagatagattaaatataagttccatgtatttttgaaggtgggagtgttctttggtacagttcccccaaaaaactggttctcatgaggcttatgtggtaattctgttaacgagaatgtatgattatctgggatactctgttctgctctccatcctggataagagtttactttgaaagtctagttgatcttttgtgatttctgcacaatgtaaaaggtactttaacttcaggagatagggccagcaatcagatttgatgatggaaaagagtagtgtagcatttaagcataatgtatactctataataaatgtttacaagtccaaaagtgtgccatcagaaagtaaccagatcaaaggagaggtgaccagagaagctggaaagataagaaataaacaagtttcaaggttactgatctgtagctgttgctgtccatgcttcttggcagctttaattatgacagggagagggacccagagggagagagagagactgacttacacataaaggcattttatcacaaagccatctaaaacaaaagtgttaaaggcacaatgctgtgtttaaaaagcatgtacttctttaagagctcaaatttaaatatataatacaaacttaagatccaaggaagaaaatggacccaggacacgaagagaagttaacgccacaggtaatgcagatggccaagagatgtgtgaaaaagataatccagcctcaccaacagccacagaattgaaatgagatacctgtttctgcttctggcattgggaaagaaagaaaaatggcactagcagccttttttttttttttttttttttttccccaaaaaatttgctactcttgaggttctgtcaaagaatgtgctgtggcctctagaagcatttttaaaaagagactttcacaagtgattgtgcaaaattgtgaggtcactgaataggtgtgtatcctcctaaggaggtagcgttggaggagctgttcttgttcaatttactcagcacctgtgaagaggcttcactgtgatttgcctgtacaggtgtgcaggtaaaaatctaagttccacaggtagtgcaaaaaaatctacctccctaggtacctcgtacatttatcacagtttcctggtaaacagttctgctgttgttgacaaaattttatcagaaacattgcatactcttctctaaatagtagtttccctacaagtggctgtcttcagtttagtcgtttaagttatgttgacataaatgattatgtgtgtggcaggggcttttgcgtaggttgttgaaacattgcaccttttggactaacagtttttaccaaaataggcagaagtgacatttgcagccacagctgtgtggcattgagcgtctaaggtatgtgtaataggcagtgtatcggtagcattgataccttggtcaacaccagtaagccatgtaattgcccagaagtgggctctaacactagttttaggagatgcagccaaaacgacaaagctggaggcctctccctctgagcttggcctccacttggtcaaaacagtccccagtttgtccctacgggacacaggcctgccttgttaggaaatcagcaacatttaggagcccacaatacctcacataactctgtgtacagtaacagagaatggaaatagggctgtaagcatgaacaaccagtcaagttacaaatatagaatactctctcaattccactttagttagtcatggagggacagtgtgagttttataaacttataaggaatatacaaacagttccaaatttaaaataacttgaagtaacttttaagtgtgtgaaaagaatatttttttccaccctgtccatttaagcatctgtgacaggcagtattaagtgatgggtgtctttacgtacacatgcctgttgctcacagtactggggaagagttgcaaaatagtcacccattctgcagtgatttctctcttcttatttgtgaaagactcaaaaaaaaaaaaaaaaaaaaaaaaaaaaccaccaccaaaaaaaaggccaggcacggtggctcagacctataatcccagcaccttgggaggccaagtcaggtggatcacaaggtcaggagagcgagaccatcctggctaacacggtgaaaccaaccccgtctctactaaaaatacaaaaaattagctgggcgtggtggtgggcgcctataatcccagctactcgggaagctgaggcaggagaattgcttgaacccgggaggtggaggttgcagtgagccgaaattgtgccattgcactctagcctgggcgccagagcaagactctgactcaaagaaaaaaaaaataggggggatgtgggttgtgagagcgacactgtgtgtccatgcgtgaagaaacccggctcatgatgacctcgccccagaacgccgaagcagggccggtccagcctggatttcacagtgttcttcattgcctttgtccttgattttttgtcgttaccattataacttatctctctttcccaaatgtataagtaggctttgaatatgagtttaaaagaaagaattcggggatgatttcagagtacactagaatattttttaaaagaatattttataaaaatacagtgatagtaaaagaagtagaaggccaaattccgcccccagccccttcttaatattggactttattcctttgcttttttcccttgctgccatctaaggaggctttctgtgctatagcatccagttcctctgccaggcatttctgtaaagatgaggcaccttccactgttttattctccatcattagagcacgtgtcctgctgactcggagcagaggggaggcacacgggggtgaacattccctgacagattggatgtctcttaactcttttttcctggtatcaaagaatggcacaatttagttgatttgatagcgttaccaaatcgtttttcctttagaatgaatctagaatgcagatagattctgaggtccagatgggcctctctccaccaacctgtgaccagtgtacctgtgattttatcactgcacattcatagaaaggttacagggctaatcttcccgtgatatgaatcatgaaagtcaaaatttatgaatgaaaataaaaaggaatgaagtactgatatatgccacaccagagataaatattgaaaacattacctatgctaagtaaaagaagccagtcacaaaagacactacctattgtctgattccattcatgtaaaatatccagaataggcaaatctatagcgacgaaaagtgtaatagtgattgcctgggaaaggggcgtgggaagcatggctaacgggtattgggtttttctttggggtgatgaaaatattgttaagattaattgtggtggtgtttgtacaactctctaaatatactaaaagctaccaaattgtacactctaaatgggtgagttatagggtatgtgaattagatctcaataaagctattgtaaaaaatgtgtgaaggaaggggaagcatcctataacctataccatcccaacagcccagctagaggacgattcctgagcctccttctcagcctttgtgttaattctttgcattgatgacttctctctctttacccttactaattagctctcaaaacctctatttaataatgatgctatttataactttcctccttctggtttcttgcttgccctttttgtggtgtttgcttgtttttcttttttctcaatactctgcccagcgttgcgtgttggttccggagacttaagtgatccagtgggcactgtcaggcaattatttcttttgctcattaattaagtgttcacagatacattcagcagccaaaccttgtggcatgccttctgtcccagacagtgagaatctacttggaacttggatatttctgtgagccttgattatatacaccaccaaggggatggcatagaactaagttttttcttcttctccacaacagactttgttctttaatttcacaagcttgacatagcctataagacatcatagtggtaccatagacagttttcccttgatgcccatgggggatttgttctgggacctcccacagataccaaaatccacaggtttatcagcaagggtcactgctcaattgcaacaactgaagcagaagctcctctcatcagaggcagttactgcagcatgttctgtagggcaaatataaccatatgtaagtgactgtgctatcaggagacagaacaacaagacccagaaagactcagtgacccacagagccagttccacccaaacaagtcttactaatgagattagataatgagagtgtattttcttcatcaattcatgtagctcagcaaggctggaaactgcttgcacacttctgcagagaaaaaaaaaagttccatttgctggaactcaataaataaagaaggccttagtgggtacgtgttatctccttagcatcacctggatgcctgacccttttccagagtgtcatgttgcctgggttttgtccttcagtctaagtgatacacctcttagtgtggcggagaaaagggtgctgtatttcttcctgatggatacatgcttaaatggaaaagtagcatgagatgaactcccatagccccttccttttattatttttaaaatattcattcatttatttatttatttttgagatggagtctcactctgtcacccaggctggagcgcagtggcgcgatctcagctcactgcaacctccgcctcccgggttcaagcaattctcctgcctcggcctcccgagtagctaggactacaggtgtgcccaccaccacacctagctaatttttgtatttttagtagagatcggctttcaccatgttgaccaggctggtcttgaactcttgacctcaggtgatccacccgtctcggccttccaaagtgctgggattacaggcgtgagccactgtgcctggccggcccttccttttagacaatagaaacatgctgcaaccacataccaccataaacacggtgggggaagaggctgcaatcaacagtcaggaggatctgggttccaagcccaggtttgcagtgtaacagctgtgtgctcttggtgtgaacatttggtcatgtacaaatgaggataatgatactgcccccttgtgatcattagggggattaaattaaatgcagaaatatatgtgagatgcttaatgtgttgtaaggcgcatggaatatatttagtgaatattaactgtatattaatacaaagtcctgtattcagaatctccagtataaattacatttatatagtagagatatgaatagtttttgtgaacaagaagacctggaacttcaggtgactagaagctcagagtgagccagctatgtttgatgatagttattcttaagatcacacagagaaacggcaagcaagctgctttgggcaaaaaagagcatttctacactgttcagactgcctctgtactgttagaataggtctagggcgtgttgcgtgagtggtgactgagtaagatgttcagagggaagccgtgaccgtcatcttggaatattgtttgaaagtctgacctgtacaaagcagcactcacttcccctgcgtgtcagacacctgcatgagggctggggagggtccagtacaggaaagcgcatttttaatatgtgtatggaggaagttcgtcaagatgggtgccatctggcagtggagtagcacttcctggaaagtaatgagctcccttggactttgtttgaagagtcacccaggtttttgtaaagaagtgtttcagatcagtatgcaatggatgactgtaaatttctcttcagatctaagaatctgtgattggatgaaagggagaaaggactgcataagtgcttgttgcttgtaaactgggccaggtggatgtcatggccctaggagcttcttgcctgcctttgcatgccataaagcagtcctgcaacccagtgtcacctcagagggatgggaatgtagaagaagagagtgaatagggacagtgatgaggggtgaaaatatgtaactccttgccccttctgtataccctagtacattaggaagttcacccttgtctaggcttcctgttaggaagacagcagactcaaaatggagtctcaacccctttcaaagactgcaagatctccttgtacacactggacttgggagaaaatgagagctttcaggcctgctatcttaacaggttcagaaaggtgtggtccagccccctgactaaccagccctgctgtgcacactgagaattctgctcaggtgtacctttctgtgtgctcctgggtgcacccccaaagtgctggttctcttgaaaacctttttatttaggttcagacagacaaactgtggtatcttccattctgaccataaagtgtttcttctgggtctaactactatagtgggatattttctctagaacaagaggttgtttctttttggcattgagaaatgttgccgatgtgattttcttttgtgaacgtttaagacacagcgcttgccacttgaactttcttttgccgtgcgtagctgattccacataatggctgcagctccaggcagaaacctgtttggaagttgttttaaactcttcctggaatctctaggcagtggctcagtggggtttttttccaaccattccttaggatgaccagaagcttgacagaatcctcttgtcttcattttgagaaaatatgtctttactgtgtgtatgtgcagcatttggttttacctcgtgggtctaagcattttcaactaagcttccttttccaacctagcagacttgtttaaagaacttcaaactaatagccaagctgtaatacggtggctctctcagcctgagaagcctgtgctcaccgtcactctcttcttccctggggtgatagggatggggagtagtgtgtgtgagaggacagaagcgaggattgattgaagattattttacgaggcgagagcatggtggcacacctgtcagctgagtggactcagcgcctgccccggctaggctgtcctcctcctgtgccagccgtgggttccctgagtccctctgcagtcattcatgggtgctgaaaataaagataccctttctgtcgaaagtgttcgccgggctgcctctgcctccctggaaaagcagcagggcacacaggcttcctaggcagcccctgagggaggggctctttttattgtcactctggttagtttgaagaccagacagaaggcagcaaaaaccaaccctttgttgaaaactctttgcctttaggcccttggtaccatgttcatgaggctccagataattccacaaatacattattattgttacctagacttggggacagagaagggtgaaacatgggtctgggaattcacagatgaatatactgtaatcccctcgagcacatttcttttaaaggaatgggggtattctaaaggagtgaacactccactggggggctgctaggcccctgtgaacggtggcagccttggccacggtgtgtgctgtgatctctcctgggtcccccgggcatcctcagacctcccccacacccaacccacagtcccttctccatccatctgctgaccacaccccaggatgtttccagctcagatcacgcctgattgcatccacacaaactgcacgccaggcatttccgtttggatgtgtacacaaaaacaacacgtcccagactgagctgatctttctgtacccctcaaaagaaaagttctgtacccggccaggcctggtggctcacacctgtaatcccagcactttgggaggccaaggcaggaggatcacgaggtcaggagattgagaccatcctgggtaacacggtgaaaccctgtctctgctaaaaatacaaaaaattagctgggcatggtggcgggcgcctgtagtcccagctacaggagaatggcaagaatccggaaggcaaagctggagcttgcagtgagctgagattgagccactgcactccagcctggtgacagagtgacactccgtctcaaaaaaaaaaaaaaaaaaaaagaaattctgtacccttccagatggtcctggacatatcttgaatctaccctgcttttcctcatctgcactgctgtcctcttgatctgggctactgaggctagaatgcacatctgatcatgtgcctcctgcttaaaatagtatttttcctcttaagagtagtccaaactcctattgctggattaaaaggctgttccaggctctccctacctcagggcacaccatctttcctcccagtctcccctcccctctgtctccagtgcttccatccttcagtcatgctgaggttgtctttgttacctttgcttctcttggcccgcactctctgttggctctgccagcatccctatgcacctgctagctcctactcacttgtccagctttggcctggaagtcccttcccctggcaggcagccctaagctaccctttgcttgctactggctcatattctcactgcttgtcctcaggctgtgagccctgggagggctgggctgagtccccgaacctgccacgtctatagggtgtaacctacctgaggcctgactgctaaaatcaaaagaagcctttctcatttgcttagctgagctaagtcctttctggagaagaatgcccacgtcctgggtggacttctgttcggcctggggcaggacgctgcatgtcagttcacctagagcccctcgcttgccctcacccctctccctttccttctcctccccgtgttgtctcatggtcagttcctctcctggcaaggcaagagaatcataaaatctctttggaccatgtgtctctctgatgcactttggaggttgaagctcactttcgtgaagttaggagcggttaatcctcctgcacgaggatgcatgcctgctagggaaagcctccctgcgtttatatggaacagtggtgtgtaccttagggcaacccagaaacagctgagatggccctaaactcttccgtattttgattcagaagctttaccttatttgaacatctgcagaataagttctttcctttagaaatgattggggataaaattgtttgcattatgaaatattgtatggccaggtggcccctctttcatgttttgttccttgtgaagaggttgagtctcctattttttttttttttttggagatagagttttgttcttgtccctcaggctggagtaaaatggtgcaatcttggctcactgcaacctccgcctcctgggttcaaacgattctcctgcctcagcctcccaagtagctgggatcacaggcacgtgccaccacacctggctaatttttgtatttttagtaagagatggggtttcgccatgttgggcaggctggtcttgaactcctgacctcagttgatctgcccgcctcggcctcccaaagtgctgggatcacaggcgtgagccaccacgcccagcctatggtatgcttttaaaaatggtttctctgcactaatgattatttaaaaaaaaaactctggcaagaacaaaaacaaatggttttttaaaaactctagaaataatttgatacattcgaggactctggagagggagagagttaaaggctgatgtgtgtgactctttttcctctccccccaaggaaaaaaaatgaagagaaggagcttttaagtgcagtgcctcgtttttatgtgattgcaaacctgaaccaatccttttagtggtggatgtgggacatgttagcttttccaacagtttagatgggcctttgtttttattgttggtcactgtaagaattccaaggaatagaaggatctcatgggcaaaatcagtttgcttttttctctgtatatttgttagtttatagcagcttctattttcctcctatttttaaaagctgaaatgcctttaatcgcactcagtgtgtttattcatggaagccagagaagagggtcccttcctttcccccatagcgccgtaattggaaatttggtagtactaggtgaaattctcagttttggcgctcgcatggaacagccatccatctgctggcgagacacactgcccggggcttttcaagaaatcccttaatggtcctgaacactaataatatttatatacattgagatgagacaaaatttacagcgggctctggggctggctccaggactctctaatcccacacttgctcacgttctcttgcttgcctcctagaatcctttcaggttgtgcttcagtgaggggagcatggtgtccgtctctgcagcaatgcttatttatgcagttcgtcctctaacaaacagagcaactttccttttgaccttcccctcttctccccatcacattccattgctgcccccgcatagagcatgtgcttatgcatagtttgcatcatttaacacgaaggaaccccttgatttgtgatccctttaagaagttgctctgtatataaagaaaatgatttttcctggttggttttactgaagttccttcagaaatagctcccaccaccgaaacacacctgacttccccagcctgtgtatcggttgtggcacggactgactgactggatggtataatttcactcactcctttgggaagtttcgggggactactgctcagatgtgtgggaaatgcggaatatatctacaggtactttgtcagtttttttttttcttttctttctcatcctggaaaatcccggcattgatatttaggtataactatttgcaagcaagtgcagagggacatttttctgttcttttcaacgttcttattactactgcattaatagctacttgatcttaatgtctattacacatcattttatataatgttttctttaaattgtcagggaaagggattctgcaagtagatgttggtccccccagttagtgtctgatgatgatggtaagattctcagagtttccttcctctaatgacaaagcatggtgatggtgatgtctgaagagcagcctcggtgctccaagatgggtgtatgcttaatactgctggcacacgcctgacgagcgggaatgtgagcgttgtttctgtaaccagttttactgaacctcacagatccattatacgacgtgaattttgtgggaataacataggctgggagtctgctctcttccagcctggtccctctcttctttcagccctaccctctctgatcatcatgtcccttgcactgcggccaggtaacctttctgatacgaaggtctgggcatgttgttcccttgcctaaaactttccatggtttcgtattatccacagttgggctaaaccctctgggacaggccttcagtgcctccccgggcagtggtccctggccttcttcagtaacacccaagcccttgcacccacagtgacctcgttgcttttacaagcatttacatgtgatgttctttattcctcccttgctcatctttccactttcaactccacaaaaccgtcctcggcacccagaagcccaggaaacaccaggcagctccactcactcccgtacttgctgtgtcgtccgttccctggggacaggattgtcgctgatcctgcgtgcatctgtctggcacacaggtgcagcacacattaaatagctgctaaatgaataaatgaagaatagatggaattatattctgttgtgaccagtttaaaaacatgaaattggaatacccaattgcagtgtttctttagatcttggaccttgaggtgacctctgtaatggatatatttgaaattattaactgtcttcaagtgggggtttgatgagagagagagagagagtgtgtgtgtgtgtgtgtgtgtgtgtgtgtgtttacagaaaatatgctaggtttgtacattcaaatttgtgttatcctcttcaagaaagtcaccttggtagacagcatatatatcccaacattttaggaactcataaaatgcatacttttttggtgtgatcagagatgggtaactccttattacttgtgggttagattagtttttggaaatagcctggagtcattgagagccaatccttatcaacaaaatggcataaatggacaggaatgggtttcttcttcactttagagatagctctgaagacatgtctcagttgggattagttcagttgcatatatgaatagcagtcattgaaacaagataaaagtgtatgtctctcacatctaaagaagtctggagtaagcagtccagggttagcctagcggccccactctcataagggactaagttccttttatctcgcttcaccattcttgatgtttcgccttgtggtccaaggttggtacttgagctccaagcattactactgcattccagccagcaaggaggaggatggccatgccctctttgttctcaggagtcttccaggaagttccagtcacaacgtttgtttatatctcactggccagaacttaagtcatatggccacctctagctacaaggaaggctgggagatgtagtctgtaactggatggccatattatcaactaaaaattactgaaaatgacaagaagaataaataatggaaggcaacctgttgtttctgtcaaaggatgacttcaaaagagaaagttgcaaaagtatttcaagcttgacagtatcatgacagttttcttcagaggtgacgctattcatttgcatgtccaagttctgatatctgttttcaagttcacctatttgcagcgaaataggaactcttggaggcaactagtgggtgtgtaaaccggtacaaactttctagaggacagtttaacccaacaagatgaattctggaaattgatcctaatgaaatgttaagggtgctcatgaagattgctttgccgattgcaataataaaaagtaaagaaaatatcttataattggggacaggtgtaacttatgatacattccacaatggagtgtaatactgctgttaaatgtttgtggaattcacaatcttttatgccaaaagaaagctttcagaatggcttgtcttttttgtagatacttgtatttatatgtccatgcacatacataagaaaggaccagggaaggtctgcttgaagatattaataaaggggtcacttgtgggtaggtggacttacttgttctctatattctctttacttgtttgtgatctctggtttttttaatcatgtatttttattacaagaaaaaacaaattctagaatctccactcaatattgcatgtcagagtcaaaaagatacacatttaaataattttgtattgttttccaatttgaggataaagtaggaaatgtataatgcaaaccagatttcatattttgttgatttagacttaatttacaagtaaggctgacagcccacagagtgtgatcacgacagcattgttatggaaataaatgccagctcatgcatttgggatgtacaccatggatctgtggttattagatactgatttcactttagcacacgaagaggcttagcggaggtggcttctaatatcctatggttctgtgggctcggagatgctactcacccacttgtcagaggcattgaaaccagagcaactgcatcttgaataggagctaggtaaaatgaggccgaattcccagacagttaagacattctgagtcacaggatgaggttaaaggtcagcacaaaatacaggtcataaagaccttgctgatctagcagatgcagttaaagaagccggcgcaaacccaccaaaaccaagatggtaacgagagtgacctgtgatcgtcctcactgctgcactcccaccagcgccatgagtgtttacatgtcatagcaacatcaggaagttaccctatatggtctaaaatggagaggtatgaataatccaccccttgtttagcgtgtcataaaaatgggcaaccagcagccttccaggctgctctgtgtatggagtagccattcttctgttcctttactttcctaatcagcttgctttcagtttacagactcaccctgaattattcttgcgtaagatctaagaaccctctcttggggtctggatcaggactcctttcctgtaacacacctatgttcttggacttaagaatgaccctcagacatggtgacttctttgtcatctaacagctttggcttatttgaggtaaaacctttgatatctaaggcagcagaaatttccctgaagtcattttgaatggtatcatctttactatagtgtagtttaatcattttcaaagtaagcatttctgcacactaaggctttaaaagagttttcagtaaggaacatatttgaaatggaaagtgagcagagcacaatgccttttaaattactgataaaccatagagttcctgtagggcttccactggctgacccacgcctgaggcaaccctcaaatgtgggtattatccccctcattttacagatgggaagagagaggatcaagatcacagaagctaatggtttgtcccagaccaaacaaggagttcctaggagagactgaactttaaagatatcgactctctgcaggtctaagtggatgaaaggacagtggtgggggtgaggatttcgtagtgtgtttttgcattgtctcctcaatgagtgatctggtgctggtggtagcagtgaatgacccagaaggatgctggccaggcccagagaaggcggtgcctcccctgcccggtctcatctccgtctctcctctctctccacagtgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagaggtcagtcgcggccacacgtgtggtcactacccgccccacctcacccgccaccctagcacacaaaggtagactctgtcggttgtttcatccgggtgcagccctcaggaagttcactgaggtgggtcattttgagagggctggcttaccttaaatgtttggtgagattctaggaacaattggcatggcttaccgcccccctcaccagtttgttttatattttaagtgcatactgcctggccatttgaaattaagtacttgcttgctggtttcgatacccagagttcatagtctctctgggtacttgccaagctgccatctaagagacagggaactgtagttttggattttcctagtctgggtgctgctagccaggtgaggctttggaagtgcaaaagaaaagacatgctaagcccccaccaccatccttgagaccagcaagcggacctaaacatcttagtgcaagagctagcagcagctcagagtaggcagtagcttaaaataagggacatttttccatcagcacttccttcctctcatccccctctaccttgaccctccctcagtgctcatcatgtccttcattttccttcctgaactttgagacttcacttgggaagcaaagaagttccttatggccaggcatgtggctcacacctgtaatcccaatactttgggaggctgaggtgcttggatcacttgaggtcagagtttgagaccagcctggccaacgtgatgaaaccctgtctctactaaaaatacaaaaattagcacctgtagtcctagctactccgaggcaggagaattgcttgaacctgggaggcagaggttgcagtgagccaagatcacactacttcattccatcctgggagacagagtctcactctgtctccaaaaaaaaaaaaaaaaaagagaagttcgttataacaaatgccatatgcccttttgtacatgtcaactggacttctataaatttgtcattggtttatgcttttgaaaataagatgttagcattgtttaaaaatgtgataactataactttgaaagcaaaagaagattggagatttggggttgctgttccctttcctggagcagagtaaagaacttttaggggctcacgcctgtaatcccaacactttgggaggccaaggtgggcagatcccttgaggccatgggttcaagaccagcctgggcaacatgcaaaccccatctgtacaaaagattaaaaaaaaattagtttggcgtggtggcacacacctgtagtctcagctccttgggagttgcaagtgggaggatcacctgagcccttgaggtcaaggccgaaataagccaaaatcgcctcactgcactccagcacaggcaacagagaccctgtctcaaaaaaaagaacttttaggaaagttctgttttagtggactaaatgcctccttcatgattagcaccagggggcctgtctttctgagtctgtcaaaatctattctacaaatataaaaatatcgttagaaaagtaggtgttaattttaaatataatttttgctgcagcttatgaagtacattgaggaagtgtttataaaggggattctttttctagtgtattatttggagacgcagcttctactgtaggcttaccttcaaatcaaagataatacattcttttatagtattagatgtagagcaactttctccctcttataatctgtataaccattagcatactaacaacaagaagaaaattactctgaatactttaaaatgataaataggccaaggacttcaatgagctgtagaggatacatattacatccaaaatcagtctaccacattgtactcacattttgttggcagccttcgagtgtaaaagggcttttactggtgcacacctcgggcccaggggcagtgcctggaaccaagttgaggctcagacactattcagacgtcaccttcctccttggggtggggttaggggagtggtagcttgtccatgaactcagtgtgctatcgtctttgttttgtgaatacattttcttaatgacatttggaggccttcagtcgttctgcagccaccagagttgtggcaaagtgggaatgctgtccatttgacagtgttgtttcttccgctctagtgcactcttcagagaattgagccattatttcccctattcattcttacagtccgttaaaaactatacatctacctttttgtttaaaaataaaacaccataaagaataataaattcccttctctcagcctttgaggcttatttaacaattactttgaaatatttaattttttcatcttgtttataccttctctataccatagtggatttgaggaagcttaatctataaacatgttatcaaaacacttccttagaaaaacattttttaagtgcttgatgactcctagactttttaccaaagatgattggttccattttttttttcttttcttttctctttgatagactctggctgtgtcacccaggctggagtgcagtggcacaatcatagctcactgcagcctcaaactcctgggctcaagtgatcctcctgcctcagcctcccaaagtgctgggattacagatgtgagccactgtacccagcttcagatttttctatttgagtgaaagatggagagaaactaaacatacacttatggtacaacccagcagttgtaaccctggatatttatcacagagaaatgaaatttatgtcaacacaaaaatatgtacaccatcgtccatagcagctttatttgtaataaccccaaattggaaattactcagatgtcctatgatagatagttagttaaactgtgggacatccacaccatggaatattattactcagcaataaaaaggaacaaaccattgaagtacactacttggatggatctcaaggacattatgctctgtgaaaaagccaacctcaaaagatcacatactgtataattccatttatgcaacatcctcaaaatgacagattatagccaggcacggcggctcacgcctgtgatcccagcaatttgggaggctgaggtgggtggatcacctgaggtcaagagtttgagaccagcctggccaacatggtgaaaccgtgtctctactaaaattacaaagtttggccagtcacagtggctcatacctatctcagcaccttgggaggctgaggcaggcagattgcttgaggtcaggaggccaacatggtgaaaccccatctctactaaaaatacaaaaattagccgggcctggtgatgggtgcctgtatttccagctactcaggaggctgaggcaggagaatcacttgaacccaggaggtggaggttgcagtgagctgagatcatgccgctgcactgtagcctgggcgacagagtgagaccctgtctcaaaaaaaaaaaaaaagacagattgtagacatggaaaacagattagtggttgccaggtgttagggacattggggactaggttgggcagggcagtgagtatgaacaggtggcattagggagagcttggtggtgacggaacagttctgtatcttgattgtagttgtgattacacaaatctacacaagtgatcagtgacacagcaccacacacacacacacacacacacacacacacacacacacacacacagagttaatttcccaggtttgatacttatatcatgtaagatgtagtaaacattggaggaagttggatgaaggctatgtgggatctctctgtaactttctcgtaaatctttgcagctttttgtgactctataattattttaaaataaaatttttttttttaaatggaaagtttatagggtatgtagataaattagaaacaacagaaggccaagtaaaaaagtgctgaaggaagcctctacccaggctggaaatgagaatgttgaatgcaatggtagaggaaggactctccccatctgtgggtgggtccagttcctgtaggacccttggggaagccatgacccccattctcccaaacacacaataggaaaataccagagaagttttgtttacctgttagcttttaaacaaaacagaaccctgcatctttgtcttagatacaaaataaccttcatgggtagggggaagggacattaataaaaagagctataatttacattgtttttcttgaatgtttttacttcacgaaatttgagagatgatttaagaacaataatgtacatataatggctccccagcttaccatcctattacacacacatcgcataagttcgtattatttgtcttgtttggaaatcagtccaactttctgacccttgttctatatataactatagatcccaaaggttcagctgctgggctagcattttgtctgctatttcctaaataatggtaggtaagcaggaaaagtgccagtcttacttgtccctgactcttggtggttcgtggcatgttcaggatagtatttgaaacaagagctcattacaaagtaatggaaaccccttgcttttattgtgtatgcagcaaaagcaacatttggatcaatttacaagtttctgcaaaacaccgtcaagaaataatttcggttgtgctttagcaagaaaataatggatctgtgctataccacatgccttttggtatccctcactgggctttgccaaaacactgactgcaggagctagactactgttaggcagagacactgcactccctttgctgtccctgccttctctcctagcgactcctccaggtacacaggccagggtcacagtatcagaaagcagctctgttttcctccagaaccccccaagcttcctttctgcagcactgtctctcccacatggaaccagctggctcaccagtcaacagcctatgacacacaaatgccttgaggatgcagcatgtattttgtctggaagcaagcaacacgctcttcctttgtaggctgtttctccttttgcttgcaatgtgagtggcttatcttgggtgggcttgggggtgagataccatgtgaccacatgaacacttcaaaacagttgctttttctaatgcatgctgtaataacaatgaaaagcatatccttatggtttttttaatgcaagaagacagactcaattatgtgtgtttttgattttttttttcttcttcaacagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggagtaagtattccatccccctggaaaaacggctagatctcatggttttcttttgttgatgcttttcatgctcccgtccctgagtcaccactaaaatatgggcttagataaacaacatggtgtgtaagcctcacgcatgacgtctcttctttgagtttccctgaaagataaagaacagattgaaaggcaatctgtcttttagccattggcacgtcatttattcctgtaaagagggtcatcgctcatctttttgttagtcacatcttgcataggagaggcaagccctgacacatacaaaccccagaagagaccattggatcagacgtgtgactcagcagactccagctgtagccaaatccacacatctttcaagtctaaagagttttggttacttgaatttactgagaagactgagcaaagggaagtttagtgatatcacgttaaaattttatgaagtccaaaagaatgctagatttccaaatttacttgtgagagacaaaaggatacaagtgtgtgtcattgtgtacataaagtttcggtctcacccctgtacaatgacctttatttgcaatagatggcattcctggtaagttgcttctgagttggatttgtgcaaaggatttcccactgacttagcctatgatctcttcacttctttggttttttgtgtgtttgttttttggttttgttttgagacagggtctcactgtatcacccaggctggagtgcaatggcataatcatagctcactgtaacctggaactcctagtctcaaacaatccttctgctcagcctcccacgttgctgggaccacaggcacacactaccatgtctggataattttaaaaatcttttcacttctgatttttcattgccaagggcttctagtaatggtgccttaaattctctgccactgggaccacttggtcaaggtactgatagttttataagctagaataaatatcgtaaaatggctttgaagttgaaaggaattttggggggggaatccttttatgaagaatttttttttttttttacagtttgagaggaaaaataatgtattttgagaatgtgttttccttaatatttgttaaatgagtagactgtattcttaaggtttagaaaggacagaaacaagtttgtgcttagttcttctgaattcgttgatatcccttgttgctgttcacaatacacccactcccagccctccgtgatggagataactctgttccccacaactagggcttgcccactctcatggtacttctgatgtttaattcttttggctgtgtctgcatttcctcatttacttttaatttgcttatccctagaacataccttttgagtgcctaaacttttttatcttcctgtcctgaagacaaaaatttaatctgtgaattaaacccatggagaagtatcatttatgaagggattggtacatattgatgcatgatgatgaaatgtgtcttctggtttatgtccattgcaggaaatagattggatttaggatgatgggacatctcattagaggggaaatttcctgatcttgactaaggcatgcttcctgccccacgtttaaaattcaggatctcttccttaaaacatcaactgcacgcaacctctcatctttccaacttgaacttccctttaatttttcttggaaagctattaaattaaattagatgtagggctttatcctttagtacccttattattttatttgtatcaactcaaagcaaaatagagcattttattaaatatgtcttcataaattacgcacagtaaaatcccattaattggaccacacccagttcattatagtgtttattataattttagcattagttgaactgaaaattggtttttgtttactatgagaaaaaggtagactaaacaagatgaaacctgttgtttgcatattatgtttgtacatctttattagcaactatttttccaactattttcaactatttttccaactattttctagttataaaagcaatacataaatactatagaaaatttagcaatgcagaaatgaatttttaaaaatccctcatagatagccattgttaacattttggtgtattttcttcaagtcttagtaaaatggaacctttaaatatagatccctgtatcttaggaattagaaaggcagcaaaggcagttcctaatgagatggagaaaatgttgatttagtcatgcccttgtactgtgggggccatactgtctgttgacagagcatattaaaagacgttccctacattcgtcagccttagctaattggcagtctggtatttatgattttatattttgttaatcagcttgggagctgcagtaccccccagcctcctagaaacttggcttcccctgcctgggaggcctcgttccaggagtcgttgttgagagtcaagccagggaagtgtgtttttgtcagggagcagccagtcctgtgctgggagcatctcagggggcacctgccgttgaattgttctcacttgtgtttgtaagaatccaagtatgtcacccttacaccaagtgagcacacagtgacacaatcccctttcaatgtagataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggtaagtgccccaaatttcatgagctgacgttctattacaaaataagcagcgtgcttatgaaactgtgttgctgaggtaagagccctccctgccttgttaaagagaagaaaggaggaagccgcagtattgcctgtgctgctcgagtaggtcttgggtggagtcatggttctccattcttaggaggttgctgtttggaaaacagagatgttatcacccttactggattttgcctcatcagtcaagggttgcgtgtctgactgtgaccagtgagacggcagacgggggtgcgcttagggcttttctgccaagaatgacagcagttggtctggagtgctcacctccctgtgaaatcattgttcgcgcgaccctcatctgcctcaggatgctgtactctactacgcacaactgctccatcttttaagatattggaagtgagagcacgggaggagcatgggcggttcgttttgttagaaagaaacccggattcacgagatggtttttattgattagtttacaggatttgcactattgatagagtttttgccttggcacaggcctgctttgtgataggggttttaaaataaccgtgggcttttcactggaggataaaagccggtgcttattgcatgcacaattgctttccagccgtcagcctgtgtgtacctttgcatatgtacttttctctttaaactctcccttttaaatacgactcttgccaggctttaagtgaatgcttcaaaataaaaggagttatcaattaaagagtgaattccttccaaagagaatttgggaaaataatttaggaaaagaagaggcgagaaggtcatgggaaaggttgtctttgctgatttatctgccccaactggataaagttactgcataagggtttctttacagcctccctgtttttctcagactaactcttggtcagtcttaaattcttaaaattccatcatctgatagagctaacgagagcgggcagctcttcattccatccttgaaaagcacagtgtcctccccactggggaacaccaatccttaaaaaacttctttctcattgcaaatcgaaggaggctgccgctgcacccagccccagactcctcagtcacttacctggcaagctgaggccctaccagtttaaggtgatgattattgtttcttgtattaaattttaaaatgaatttttctccgctttttttttttctaagtaggtttgtgtttctggaatctcgggtgtctgtgagcatttcttcttcagcagagcagtagctgtcaaattttcttgttgcttaatgatatacttttttgtttctagactaagcaaatgatagacatagaggtgaatgctgagaggagagtttaattaatttccattaggaattattatgtggttaccttttcatggagtgttaactaagtattgtgcacttaaatgtagttagaaattaaagcctgatttttatttgcaagaatatttatgatgtctttctcattatctgaaacttgcataaaacctgaagcatcagcaaaatctttttaaggttgcgtgctcaggtgtttgggaggctttccaggtaagcccgggcccctggcctgctcttaccattttagatgcaggggagggcaagtgggccttgggttttccctgctgctgctgctccccagtagtcctgcagctccaaggatgctggctccagcctttcattcctgcgtgcagcttctaagaggctctttcttgagcttgggctcttaagaatcttttacctcccgatgggaagttttctctcaccctgtcttcctggcccatgaccacaaaggtatagcccatcctcacgatgatgagctccccaagagctctgtttgcttcaggtgttgagaccgctagcaacacctcagctgttcatttctccttagactcagggacagagttaggtctggccccttcactagctgccctcacttctgcaagaagggaagagtcagagcgagaaagagaaggacaggatacgatagtcagataaacatcagcagtgcaaagcagaactcgcacagtgatacaagggaaagaaagaaatgtgccctaggcatggagaagagccagatacctgagaagatcagacaggcttctgacaagaggtggcatttgagatgggccttgaaggctttcgggaaaaacttgaggaaagcagaggattgaagtgaagaaaggcaattcaaggtagggtggcaggagcaaaggcaacgagttggggcatcctggggcctgttgggcaactaacactggagaggtgggtggtactagagttatgtaagatgttttgcacgcaggtataaagggttataatttaggaagaccatggaacgtattcaaggcttttgaatagaggagtgttagcagagctgtctgaaatttttatttcggtgtgcttttggtttaagccaagatagctttcatcccagtgtttctcaaactttgctacacattatggaatcattgggggtgggggcaggggtggagttgagaaatcctgatgtccaagttgcacccccaccccaattcaataggagcgtttggggttaggatccaggaatcagtgcttgtctaaagatccctaggctcttcagcaggcagcaaagattggaaaccactgctttatcccttcatttcttcccatgtgcatatcacaaagcactttgacggttttttttcctaaatattttcccctcacactgctgcctaatgttttagaggttcacccatgttgttaacacgtgtcacactattttcttgaacttttttttttttttttttttgagatggaatcttgctgtgtcgcccaggctggagtgtagtggcgctgtctcggctcactgcaccctctgcctcctgggttcaagcgattctcctgcctcagcctcctgaatagctgggattactggcacgcaccaccacgcccggcttatttttgcttttagtagagacggactttcaccgtgttgttcaggctggtctcaaactcctgaccttgtgatccgcccgcctcagcctcccaatgtgctgggattacaggcttgagccaccacgcccggccttcttgaacttcttttatagccagtgataacataaatgtttccatttggttcaataggatgaaagttctgttctgtagccttttgtttttgatggagaacagaacaattcaaggtacagagatccttcaactctgacaaccttggctttccaaaatgtcactgagatccccctcaaaaagtctcctgagccatccagaacagaaaattcaagcattttacatagagtagagctcttattcctcactcagagcctgttgacttttatatcgcactcggcgtgagctgattttgtaacccagttacaaaagccatagccatggtttcctcaaggacaccatagggtgtatttctagagtaatgaccttagacattaagaaaatcaagaccgctctgctgtttacaaaggaaacaggttttgtaatccacatgtacacaatttttataaaatagctaatttttaagctcttgagtaagagaatattttcactatctggaaaatccccttgtttggacaaccttgtttcctgatggcatcagataaataaggagttaaagtttcacattatttggtgctaccaaggattgttgccttgaaaagaagaaggaaaaagtagatggagggtggtgagttaaaagaattgaaattcgcggataggcatttctatgcttttgttcctaccactcgactgtgcaacacgcagtgctttgtaataccttcttggagctcaaaggtcaggctgaaacatggccgctttttcacatttccctgggacttttggaaaatatacaccaaccctgtgacctagcaattccgggatccacccaagagaaatgaaaacatgcccacacaagacttgtgtatgaatgctggtagcagtattactcataatagcctcccgggattcccccgacccccagcccaaaagaaagacccactggaaaccattcagatgttcatcagcagatgagtggatagaaagataaatggataaatgaaatgtggcacaaaggacaactgactactcaacaataaaaagacgtgaagtatgacacgtgttacaacatgggtgaacctctaaaacattaggctaagtgaaaagaaaaaatccagacacaaaagactacatattatatgactcattcgtatgtaatttgcagaaaaggcaaaactatagagacagaaagcagaccagggatggctgcaaggaagaggtggagattgaccaccaatgggaatgagggaactcttggatgatggaagtgttctggaactgagtagtggtgatggttggacagttgtgtaaatttacggaagctcatggaatgatgggtgaattttttttttttttttttttgagatggagtctcactctgtcacccaggctgcagtgcagtggcgctgtctcggatcactgcaagctccgcctccgggttcacaccattcccctgcctcagcctcccgagtagccgggactacaggcgctcaccaccacgcccgactaatttttttgtatttttagtagagacggggtttcaccatgttagccagtatggtctcgatcatctgacctcgtgatctgcctgcctcggcctctgaaagtgctgggattacaggtgtgagccaccgtgcctggcctgatgggtgaatatttgataggcaggttatacttcagaagtaaagctatttttaagaaacacctaaacaaagaggaaacattgtctgaatatctgtatggtgcctggttccacctagatagacatatccacccttgctgaacccctaaggttgatgtaaatattggatttgggggagagtggacatgatataaaccagcctgtttgcagatggattggtgggagcatctgcagaaaggcaaaaaaggccaaatactcttatcagttgcagatggctctgttgctgatgacagcctgtgtcctgggttctgatgccccctagagacagccgtgaagaggcaattttctcctcgaaggaaggaactggaatgattggttgtataattgcagaattgttttcagtatgtcagcaagcactgaaaatggggaaactgtcccttcctacctctgtaggctggagacctcgggttcagctccatttatcagggcacaggaccttcctgttctgagactttgttccaggggactttcacacttcagagaatagcacatgtcatcctgcacttttgtggggtgattaaaagctcacggtatccttttatgtttagcccatccaattcttccaactggcctcagccagaaaagcagggaaggcacccccagtttgcagctgagagactccagcctgggagagctgaataaatcttttgcccagaggggttcctcagtaaatgctggagatgaggctcagacctgacctttggattcccagatggagtgctctgaaccgtgtacctggggctgtcttcaccactcaaatatcgatagagataacatagagatgtcctcaggaagataaccaactgttcccatcctgtgtggtctacagattgggagatagggcctacccaagtgtagaaataaacattttttacaacatagagaaggctgagaaccaggataccaatatcaataaaatctggatatcatagagcacatggaagctaaagaaaaataagtaactggtcaggtgtggtggctcacacctgtaatcccagcactttggaagaccatggcaaggcattgcttgagcccaggagtttgagaccagccagggcaacatagtgagataccagctgttaaaaaaaaaaaagaaaagaaaaattaaccaagcatggtggggcatacctatggtcccagctacttgggaggctgaggtaggagggtagcttgagcctgggaagttgaggctgcagtgctctgtcattgcaccactgcaccccaacctggattacagagtgagaccctgtctcaaggggaaaaaaaaaaaaaaacctaatttttaaaagcattctttgaatgtaaaggcagtaagctaagaaacaattaggaaatcacatttactgaataatttacttaagtaatctttttcttcaggaaacaatgataactttagcgtatgcatattttaaagatgtgcagacaggtctctgccttttaccttctcttaattctcacctaatcatggaaggaatttagcggggagccttgccccaagctgtggctcgaaaaacaagcatggtattgacaggcagctcatgaatggcttgattattattttgacaagggttttatttttatttttctttagcttccacaggctccataatgcctgggttttattgatattggtatcctggctcccagcctcttcaatgattgtaaaaaatgtttgtgtttactgtaaaaagataatcttgcttttcaaagtgattagtcaaatacacagaatttcagtgtgcctgccattcatttgtcaaattcctggtttataattcatgcttcctcccgtgggggagaagaatgttttgttcagaaggtatttttggtgtggttccgttccctgctagtgaaattagtttatgaaaagaggcctggttctgggtgtagatggaagtttggcctgattaattggtccttaccggcagcccagaggtttcttcatcaacaaggagattttgtcctgtaactaactcaggtacctggaagcagcccgacatttgggggtgcatcgctgcagtctcctttggagctggagaaacctatgagcaagaatgggcttatgacacatccatttccactccatccctccttccgttgtatgactgcatggagcccctctgacctccagcagtgtcacctgcagcctggtagtgagaaacagcaggtatggatggggtctacccccagcaacagtagcgccagctgggccatatcctggcactgctccccaggaaacacaccttgtgttgcattgaccagatctgggatcatttggacaatgtcttatgctgcttttccaggatagctgtgtgttcaggagggagcccttactgaaaggaaagaactgttgacttacaagtttttgctaccggtttggtggtcactaatgtgtccagaggcctgaagatgggcgtgtgaggagcctgacttagcttcagaggctctgtctttcgactcacttgtgtgctcactgcacccctgtgctggcaggactccaacctccacccccagcacttgtgtggacagagagcccagtgctcaggaaagggttgggcttcaggcttgtgatgcagattccgtggtggctctgtgactccttctggtcgttcttaaagtagacagggagcttagatgtcacctgtgcattccccttgttgtcctacgagtgagtaaacagggctacagatagcactaagggatctgcgcatggctgtgcagctcattcatggcatttctggtcctgggtcccagtctctgaactccttcctggtctgacgtccctttgtgaatgttcaggaaaatgtcacagggctgcttggcagcattgtaaccataatttgtgctttactgtaaatgagaatcaggctgaggattgaccagctggttagaggtcctggtttgggtgtaaatgaagaccctcaccagatgcagagagatccccaatggacatagcctccagggcagacgaagccttaggggttctgttttgtcctggctacgctggctctgcagggagggctggggttctttctcctttgtgtgtttatacattagatctgtgagtggatcttagaagtcactcaaagtactgcactgattcccaaacttagtaagaagcagagcaggaagaggagaagaaggattcacggtccatggggatcaggcccatcagcacagaggactcagaagtcaaccctggcattgtctgctgccttcctggggaagccagagagaaaggcccactgcggggatctttctctagacctaagccgtagctgtctgctttcttgcctctccagggatggacttgtcctgccacctgggtagccagatagaacggcttcctgtgctggttggatctgctactcgtgtgcacaccctctggggcagaagccacgtctggtttggtgggctttggtcctccaccacctcactggaactcagcctctcctagattgctggttctccacgtgtggtccagggaccacagcaggggtcagcaccacctgggatttgtgataaatgcagattctttgcccaccccagctgaatcagaagctctgggggtggggcccagccctttgcaaacaagctttgtgcacactgaacttggagaaccactgtgttggactccgagtcctcttgcctggatgagaggcccaagagcactgcatgttagtggctcttcctcctcccccacacctccagggactggagctggggctgctcagaatgaaagatgaatgggggagggagaaggcccagggttgaccccccacaagcttgtctccctgtctcatgctgtctcctatcccatcatgctgctgattgggcaggatttacttccatggataatgggagactttagagcaaagtgtacgctgttccgattgggtagcagagcatgtctgttctctcatggactgctttcaagcacgttgtacatacttggctgagaaaaataaccaaaggcatttcttgggaatgattctagtaacatcctctggtacaagaagcattatttgatggtaatagtggtcatagaattaattagcatcttaccgattttgatatgttatccttgaatcatgttgctgccattgttaacagcaactgtctgttctcctatagtgttaataactaaatctcttattggcaaaggaaatgtattgtggagcaggtggcaaagaggacctgtgttacgtggccagcaggctagaggggactgtggccaagggcaggtgcgctaacatcgatttctgtgcttctaggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgagtgacagcatccaaaacaccgtgggcccaaccatcatgataacagcagaccctcctcccatgtgtgatggcagctttcctctgcggcccctcctggtttcacatgggggaccactagaccatcttaactagcactttgctcctacttatatgtcatcacaatcagtagtgggcagatacgtgatgtattcgtatttataaattctgtacatctctgtgagtgtgtgaaacacttataagtaggttctcaaactttaaagtgctgcttacagaatgcacagttaaatgtccttttatacacaggtgcacagttagatatttctctttcttttttcttttcttttttttctttttttttcttttttcttttttttttttttttttgagatggagtctcactctgtcacccaggctggggtgcagtggcatgatcttggctcactgtaacctccacctcggttcaagcggttctcatgcctcagcctcccgagcagctgagattacagacacctgccaccatgcccagctaatttttggatttttagtagagacgggatttcatcatgttggccaggctggcctcaaactcctgacctcaaatgatccacgtgcctcagcctcccaaagtgctgggattacaggcttgagccaccatgccctgtccgattatttttcagggaagagccagtgtgctccagccctatgagctctacccttctgctcccacagaagggaagcacaggcctgtggggtggagggggctctgccctaagcgcagcccctgtgggccacgggtttcctgtcccttacactcggctgccttgtttctcccaccccaacatgaaaaagatggagtgagcctgcagccctgagttgatattgctttttaaattgagaacaatataattacagccttgtactggttataaaactttaaggtctcatatcagagatacagcagtgcctttctcatctaaccctgtgtagaatacggctgttgagaatggcgtggctctctggctggatagggttataaaagtaaatcgtcttttcacctttggcttttaataagggaagggtattagaaaaaaagtaatttgtatgatgaagggtgatttgtgcgtgtgtgcagacagacacacatgcagggaggcaaatcagaaccgatgcgtgtttggctttggcttgtttcgctggtgtctggatttacctggcgacacttgttgctctgggggatcttagagggaagcacgctgactgacctagggctgaacagcaggctgacgaccagcgccgcctcccgccccctgctcactctatccctgcaaagcccctgccttgctccctgttcagatcatagtaaaatcggatgtatccgagtatttcagagtgcttgtctccttagagtcagccagtctgacctgtcagatcataatacgtagtagccgtttattttcttttgaaagcaaaatcatggtttcctctctaaataacacttcagcaggaactgtgacatttcccaatctcagttgcgcacattttgtcctaaagacttcttagctcttttactgtcttcagtccctctgcttcacctcttgagtgtgtagtgggattcaggcagataagagggcgaaaggacaattcgtcagagagctctgggtctccatgagggtgggcagtcatcagtctttccctggtccttatcgtagtttgaatttggtccaaggaataagagagacacttggcacagcttccctgccatacccgccagccaggctacttcccatagagcacgttaggcttggccaagtgagatcttcttgtcagtgcttaatccagcctcccgttgtttgtcagccctagctggaggcctcacaggagttcctgtgtccttccagtttgatacgaagtttagaccaagaaaagttcctttctgtggcacacctgtagtctcttacctgtctttggtggttgtacacgaacaggcagatatccacaactgcagaacaagtgtcatcgtctctcttaagaagtttcagggcagcctaaaggctcaccttcaccctaccaggccccctttcatagccaggatcttagggatggagaagaaagataagttcgcctcgttcactgaagtcgccccttgttttcaggttaggaaacccaggttcatgtccaagtccctgggcaagtagccagcgtaactgattgacctaaaacaaaggatggagcccttggggctctgcatagtgaaatgtatgatttcttagtggaaaacgagaaagccactgaggaagcccagaagggaacttagcatatacagccagctttggggaagggggaagcagtgccaagcaagacaggtgcttttcagagacacatgaatctctgtcactcacggatgtactctttgccccaggtgaaagtgacgtcctgcatttcacctccaccaccacgtcgaagaatcgcatcatcataacctggcaccggtaccggccccctgactacagggatctcatcagcttcaccgtttactacaaggaagcgtgagtttctgctttgggtgatgccattctgttgacagggctacgaatgggagaggccagtctttcgatccttgaatgggctggctgaatacagggggtcagcagagtccccagggagagccacgccaaacatccctacttcatcctcatgcaccctctcgggctgtccctgtgatgtcagtcacagccagtgacagccatgattgggaaagtgttagctcgaggcctgtcattctttagtgagtgattagagatgtttgaataaaataaacccaaaatggggaaagcttgctttttccagaattaggtcagtccagactcatgaacgatgatgggggacttcactgaaatatcgtttcagcctccttacctactaggcctactccaggaacaccctgcaggcacgtggctcttttgtatcatcttattcctgtctctctctctgtgtgcctctcccaagctgtggccctctgctctaggtcatgagccttccaaacaagcgaagaaaagtggagagagaacaaccttcatgtcttgagccttttgtgacttctcctagactctgttgggagcttttcctgtgtgatcacatgacattcacccatctaagcagccgaggcttattcctcccgactgcagccctctttgatctccctcttccttcctttgccttctatatccaggtggctaccccggtctacttagccatcccccttacccaggtcccatgttaatcccatagttctctctcccagatgtgtggcttccaaagagcagcaaccagaggcaccttatgacagcatcttgtactctttcctcctgccagagctggggtcctatgaatgagaaattgggtacttaggattactaggctttcagagtttgtacacaggggagcccctcatgatctcccatcccatgacagcagacggtgttttgttcatgtttgtttcagaagccagcggccagcagctgtccagcccttttagctgataaatataaaatacctacccaaccatgcatctgtgcgaagtactatattctctgatagtcacaccagtgctttggcaatgtcagctggtaatttcactgaggacttgatgctggtttctaaggcaatctggaaactaaatatttgaatattataagatgcttaagcatcagaattgtttatgagcaatctgaattttagaagctacttctgtttgtctgtaggaaagtcatttttctccaacagttaccttctttcaatatctgatatttgcattaactgactatgcttgtttttttcttgatgaaaaaatgctgcaatcagaagagagaaaaatagtttttgcatatgttcttaaggaatagtaactattgaatcccagtaactgttgaagtggctcttcctgaggcagaccattcaattctgtaatgcccgactggggaagcccagagtccagtcacttcatttcttcttctataaaagtctaattgattatttgtttatttagacctcccattatagaaagtgtgacatgctgggcctctggggaagatttttgagggttttgatgtcagagccccgaactttctctgaacttaattgtctttcagaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcaggtatccatgcctagacaagcccccagcatccacacttcttcacaagctcactggccttgcttgtaccaggtgtcattgtagggttagcagtgagctatgcctgttgtctttcttgtcaataggtaatactgtgtcatattcatttccccactgctaacacattaggctcttctgtgccattttctggcctcggtactatcttccatcatctcctgctttgtgcctgtgagcccaggtcctccagggtgctgggctggtttcattggaaggcccagcctggaaacagccgtcttcagctgcccttgtttcttgtttgttttgatgttcaatcctccaggaactgaaaccatgctgatctgtgttccacttaattcatgtagctcactggttttccatcttcattctggagcttatagagttccaaagaggtcaacaaaagttgaaagcctgcagatgtagtatgttgtggatattcagagtattcactgatgatgaggttcctccttcctttatctttaggttctaaaccatctcatttctcaactccagatctggaaacagtaaaagcaaacgttaatagtttccagtatataaaaactagtttagaagtaggaaaatccacttcagttttaaagacactgattgttttagtgtattggagcttctatcacaaaaaaacagtgtagcctgggtggcttataagcaatagaaatgtatttctcacagttccagaagccacaaagtgcaagatcaaggcgctggcagatttggtgtctggtgagggcccactccctggctcatagatggctgtcttttcattgtgtccttgcatggtggcagggatgcgggagcactctccggggcctctcatagaagggcctggattccattcatgagggcttcactcccatgacccaatcacctcccaaaggccatgcctcctaattccatccccttaggggttaggattttgacatgtgagttttggtaggggacacagacattcactctatagcactgataaacattctttgataatagccattattttagtgggtaaggtgtttttaaatacccataagcgagcacaaaatcagtttaaatggcagagaggagggtgagaagaaaatgctggtggggaaaaccttttgctgtgcacgcctgctccttcctccactcctaccccatctccatgaccctgtaagtggccacagtcatgtcactgggtaaagtgcttattgaaacaaaattggcacaggcttctgatcctgcgtgtgggttggtgtagcagaggttcagtgcaacagaagaagtttttcatcttaaaatttggaagtaacccctggccagcaattcactgtagtgtttgggaaacataggaatatctgcttattgtgacagattctcaagaaacctgtttcctttccgcaaagatggaaaccaggcactgtaccaatgagtcagttcactacgttttgtcctctgtccttacacgcagcggagacagacgagaacttggtcctctgcctctgctgtttggtgacacctatcgtaagaatgtatctaggaatgagctgtttgtttttgaagtacttatttttggaaaccctaaagtggctgagcatcaagtggttgtgttttctctgaaaacgccagtattagtcataacctttttccaaagtatcatcccttaaagatgttcagaaccttgtgtgtatcgtataacctggagcaccctcaagctgtccgcccttttcaagttttaaaaatggcttaggcaaacatattgcttaagtgatatccagtgaaggtgtctcctgtgctttgaaaaaccatcaacattgatgcttttttgtgacccaataaggacaagatttcagtggttctgggatgcatttgatctttatgcacacttcagctctgggtttcagttcaggggtcagcataagtaaagcttgatcagataactatgctttgcctataatcggcattcattctgctggtgacagagtcctttgctcaaaatgaggcttccatgcgtttgcagttctaaactgcttttcagagtcatgcctcagtcattgtactgaaggatgcctgtggaaatggtggacttccgtgttctttgcattgcctctcccccatccctcttacacacagctgtgacatgggcatgcacactccttcacacacacagactctccagccccctttccacttcctctttccatttggcttcatgacatttttatcagagattcaaaatctcagatgaaatccaagtcagcctgttttaccagttgtcgaaattgccggagtgcagcactgtggagaatggcagttgtaataaatgagaaataccaggtgtttgaattagctgtagattttcacattgtctcttctaaccctgcttgtgcccccgcagcctttttccatttacaactcagtaatgtttgttttcacagagattaccggaggaaatagattataaagggaaatgttggcatttatagtagtactatttcaaaataaggttcacttttcactttgtatttcattgttcattgttattttcttatccaggtcaaactggcagtttcctgttggcttgccagagtatctgatagcctgactcttaagttcatttcattttctagaatgttctttgttcccctctccagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaaggtaagggtgcagcagcggcctggacggagggtgtgaccgttcattcctgtggttgtaatgtgcctgagccctaatattacacgtatcagacaacagtgtagttctccattggaaaccagctatcttctggttttttttttttttttttgagacagagtctcactctgttgcccaggctggagtgcagtggcacgatcatggctcactgcaatttctgcctcccaggttcaagcatttctcattccccagcattccgagtagctgggattacaggcatgcaccaccatgcccagctaatttttgtatttttagtagagacggggtttcaccatgttgcccaggctggtctgaaactcctaacctcaggtgatttgcccgcctcggcctcccaaagtgctgggattatagccttgagccaccacatctggccgagaccagctatcttcttgattaaaggtactgagagctattatttttccttacaagcatgtataacggctttcattcccactcttgttttggcttttcttttccgagaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccaggtacccagctcatgtgaaatttcagttggcaaaacccactgctcaggccggttctgttgcctttctccccaccaggtagtgtgtaagtcagcagctggggggtacaatacagtagccactgagacggagccgaaaaagatgacaggttcggtgaagtgagtccctgcggaagccagtcagccctgaagggaacagggaccagggcttgggttgctggggccaccggtgtgacaggtactgctgtctcagccacaaccccccacagagagcaggtgggcaccctgtggtagaggcagggaggggaaactcaaagagtattgacagctgctgcctggtgagaggaaaggccaggatttgggtccatctctgcccttcctaattatctttactgcctctctcagcctcacagaggaggagtgaagcaagagggaaaaaagtcagagtctgtgctggaaagggcctgacttcaaaacatagccaggtgccacaggcatcctgtacaagtaagtttgggaagcagtgtagggcgacagcctgcattggctgtttattccgtggttactctgtctttcaaagcaacacagcccctgccccagggactctgctcctctgctgtggtcttggtttctggggagtggggacaaaagcagaggaaagtaaacgttcatagcaggactgttcatagtagccaaatctggaaacccagtgtacatcaacaggtgagtggctcaataaaatgggctcgaaccttacagtagaatattattcagccataaaaagggaggaaattttgatccatgtcacaacacagatgaaccttgaagacaccatgccaagtgaaacaaggccagacacaaaaggacagatagtgtatgattttatgttgtgtgaaatatatggaatgggcaaatgtatggtgacagaaagtagatttgaatttaccaggggatggggatagagtgtggaggggaatgggaattattccataatcgataggttttctatttggagtgatgaaaatttttggaaatagataatgatgatagctgtaccattctgtgaatgcaattaatgccactgaattgtacccttaaaatgattaaaatggcaactttttatcttacatatattttgttttgttttaaaattttattttaacacaataaaaaatgttaaacaatttttttttcctttcaaaaaaggattagcccagtagtgtgtgggaaaggagatggaagcacagtggtgctccctggccccctcttcctgtaagattatagtgcagattttggaaacgacctcatgcctgaaaactaggccaaggagttggatttaaatcagcatggcacccatgagctgcccatccgcagtccccacagcacccgctgccagcaccccacccagcacgttcccttcccctcactgcccccgaccctgagaggagcctgtagcggctatttattccacagtgactctgctcttacaggctttcttaggctgtaacaacaaatggtttttaaagtgattttttttttctgccaagtgacctttttgatatttgcaaaatggttgaaatagctatctcacttcgagaaatcagtaaagtgggaaataaagactggttagaactggaggcattatttccttttgagagtgcgcctcttcattgcttggtggcttttttctcctcccctcctctctcgaagttcaaaccaccagagcagccaggcgcggtggctcacgcctgtaatcccagcactttgggaggctgaggtgggtggatcacaagatcaggcgttcgagaccagccgggcatcatggtgaaaccctgtctctactaaagatacaaaaaattagccaagcgtggtggtgcacacctgtaatcccagctacttgggaagctgaggcaggataatcgcttgaacccgggaggtggaggttgcagtgagctgagatcgcaccgttgcactccagcctggacaacagaacgagactccatctcaagaaaaaaaaaacaccagagctgtgagaagggcctgcgaggccctcatggcctctcctagcctgccccgctgggggagtcttctgcctgctggtgtgtggcagggctttgaatgtgaaccttgaggttcagtgcccaaggccattttcttatccaggatatctttgtatcactggtggttcctagaaagcagaaagtttgaggactagaaagattgcaaagaggtttggaaactggaactcaatgaggtttggtgacttctctgacatcctaattaattaagaatccgtttgggacctggtcctcattcccacacaccgactcttttccccctcttctcctccattgcgttgcttctcgtggtcctttccacctagaccagcagaggcttagctcgtggcagctcctgctgcccgccacacggaaggatggatttagagtgtcccaaagcaggctgggcgggaagtttgtttttctctatcatgggcccttggttacgttgctgtcttgttccaccaaccagcaggaggttcgggttgtgagtcaaggttttggaaagattttgctgaaaggccccttgctttcagttgtagttacgaggcaagacctgtttttttctcatcagatgtggagcacaaggtgaagtgacgtgaaggcagagctgtgattgacatgttattaatgcacagcattggtggtgttgggttcaaaacaagtttcctgtgttctactggagaagtgtgtttatctgtcccccgagtccttcctttctctctcctaagacaagtccaacttgtgattctctgttttcatggatgtatatgaagacaatattttgtccgtggtgagaggccataatttttaagaagttaatatttgtttttttgcctcctactgagttctggcagagtccaggtgaaggagtgtccagcagagagaatgactgaatcacagaggctggctttctgttttacacgtggattgtccgaaaatggatttgatttctttcagttcattctgagaacaatgtatttgtgggataaaaccagttaagtaagatttagttccttataaattgtccagaatatcctgtatgttttgaagtacagtggaagctagagtttgtaaaacttactagtttctgaagtcaatattcgcagtaaatgcctttctttgactactgtctttattttgtaaatcacatagtttggtttaactagctaaaatgttgacagatgttggaaagtaaaaggttttccaatagggctaggttgtattatgggatggagtggggaaagttggcagtaatgtttgcttttgggcgtacgatttggaaatgtagttgtttaccaaaaaaaatgatgtatgggccattgtgcttcccctgttcctgccttccagataatgttctgtgtcacctccctccccttgtcactgccttgatgtcatcagcattgagagctgtgcagtccctaaaagtgtgatgttgataaacaagtaaactactgagtatacttcatgaagtaatcccagttaaatgggggtgggctgagccgggagaggggttttgacagaattattttgcggtacatcaaacctaagcaacttctgacagacacaagtgtatgttgtgttggttttgaaggtaggcaggaaatttgttgatgatgtgttgacaaagatttccctgacagtaaatgtggtttcttgtgtttttcccttccgggaagcttggttagctagttggttggtttgcagagtgtgaggattgtggatgatcagcctcatgtccttacccttcctcccccagtattgtgaaagcaaatgtacacgccctgaccttgtggttttctgcttgttggaacgagcatatctgtgttgggcagttcatgccttcggtaggacccccgtgtgccactacacaaagaaggaccgtgttttcctcaggggaatccatgggctgagaagactggggagcctcagaggccctttcccaaagccctctgctctccccttccaggttctgacctaaggaccagccagaagcctgccgagcgtcagccgaacctgcaagtggcttctgggctgttccgttccctgcgtgagctttccctctctgctgctgctgccgcgctctcccctccatggcactgatgagcttcccacattctggactttctcatttccctgggcagatagaattcatcccatttgccccctgccttttgcctattcctaagaccggtgaccccagccgaaggcctcagccctgttttctcaccattcgtccatggctgacctgagggttgccctttctccatctgggtgctcctctcgtattctgtttgtttttgttggttcctgtaaacattagaattctgttttaaggtttctagggggagccacaaagcccatttcttcatatttgaccaaagcagcaattagagggtcgcaccctcatgcctcatctgccctttttggtgagaatgtcctttttgtgatgactttatgcactcccttttgcttttcggttgttccaagccccattcaaatccatgacaaggactctgctctctgatgggcaggaccttgatgaggccacaggtgctcactgctgagtgggaggaagcctgggtgggctccagggacctgcagagtgtagcaagcacagacgcttggggttgggggtgggctcgcagcaggagcccccaagaagagagagccctggggtccgtggaactgcttgctgctagactccaggcatctttatttccacagtcagagcaaatccaaggagccaccaccacaggctttcatatccctctgccccaggtctctggggcctctgccacacacctcacctctcccctcctgccctaataaatcttaaccacagctgataggtttgccacctttaaggcttaaccataaggtctgtgaccagatggcctgagtgttctgatgacacagccaggactgcctggccaagagtggcagagacactatttgcctctaggtaaaatcgaagaaccactctgagagccggggggtgggggtgagagtttgtgtgcccattctgacacttgcagagtagagaaagcaagataatgaggaaggacatccctgtgttattcatgagttcttacctaagggggctcaatagctccttctattccatggttaagattcttctgttactcttactcaagtcatagaaaagacaaaagaggtaaaagtacttaaaagccacatttctctcctccttgcagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcaggtatggtatgatccagctggccccattgccaccttcctcacaacctagtggagaagatgtgttttatggacacagggtctgacacccagggccatgacccttagacccaggcctgcctgctaaataacgtgcagtcattggcaggtggcgtgtagaccagctgcccagggaacagagcccacgctctcctagtgacaccactcccagcttggtctctccatagaacgtgctgggagcagggagctgtctgcagggtccaccctccacctgctacttggtgcacatcgtgcattcctgctgtcctttgccccctcttgcgcacaaatcgggttgccccctcctgagctctcacatgtccagagatgtctccagttagttgccttgatccagagtaaacattgcccctcaagatcaactcctggagtagcctctggtcttgcttatttagtctttggctttcccttgttgttagacactgcctgtcactcgggcattcatccatctttgaaggtgggtgccttcaaagacagaacaagagctgccctgtcctttagtaggcctcaggtggtagaaagagcacggaggtgaccagagtctggggtgtggggtcctcctgggtgcagttctggcactgaagtccattgtagcgtgccttgaggcagtcgtcaggctccctgcctcagtttccttagccctcctgggagagacatagccagctaacccctcaagtgccttttccggctgtaactttccatgacctttgcttatcacaactttgtttactgcttcaagaagcaaaagcaagaaaggaaccactgcaaggtcagccagccgctggaggagttggtgccggcagggagggcttgccctgctcttagcaccagcctcctagcagcttcctcacaggccgggctcggggccatccttcgtgcctgcataaaaattgcagttgccgcgtgtagacgcgggccacggagggtccctgtcacagccggcaggccccgtgtcctgcttctgcttactcagcatctttccagggctgcttgtgtttgatggcttcacaaagctttcttttttcaagtggtaggcacagggtagaagaaagttacttaggttgccaagattttcctgctgtgcttggcagcaggctttttttgttgagggactggggagaaaggaggatcttgtggcatcttgagacgtgcaagttttgtggttggtgtattctgaaccctccgctgtgtgagcagcccgctcaggggcagtgtacgtggctgatctccactgtcctgcccgcgtggatgggggggttattctcagtgtacgtggctgatctccactgtcctgcccgtgtggatgggggggttattctcaggtcagcccagtgttggcctccctccctgggaacccaaatccaactttgtcacctgtttaaattgtacagaaggagcagatgacattcctgggccagtgacctgggagccaaggcctgaaaactccatctttttaaagtggccggaacctgagaatcccaatggattgattctaatgtatgaaataaaatacggatcacaagttgaggtaggactggggcagtggcccgtgcctgcatgtacttccatccattgacagcatatgctacctgactgcacaggttacctcctggttagcataggacttaaaacaataaaatccatgccaagttggtgaggatttgggtctttctacccactctgtactctccaaggagtactgcatagtgtgcaaagagctaggctgctttttgccctcaagaaacgatttcattgtgtaagataaccttgtggcataggccaggtcagttctaataacttttaatccttctggagttcttggttacaaaaatgtttggttaaagcttttgggtgtgcttaaagctacttgaagacgaccttttaagatttgatttctttgtctttactgacactcaggatcattgttaggtgggaggtcagatcaggcagctggagtccccagtgtggtgagtttagttggcaggccccagatttctcctgcattcatgggaaattgacatgtatgttttatttccccaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaagtaaggcttgtggagggagaagaaacgtggtaaaactgaaagcagggtggtccaggatcaggacagcccgagtgttcatggctgtcttattttctgttaaaatggagttggccagcttccagaagggtcatgctaaggtgccggcacataccggcactgtgtgtgaaaggttgggcagggcagatgccgagctttgggctcctacctcatgtggcaggaagggagaggatccgagcctctcctttgaggttgtgtaaccactggagagccagaggagacagttgctttcaacctggcttacattcaaagacttttttttttttttaaacaaaagacattttataaagcattgaattgaccattccacctcctacttggtcagtaaagctagatagggctcggattcagggcttgaaatcctaaggggtgtaaggaactccagaggtcatctggttcagcctgctacagggcaggaatctccacggtagcatcgcagaccctccactgtccttttaaagtccccacatgcattggaaatgtacggtgctcaccctttggtacagagactgaggaatgtgagtttatgctcaagtcattaacaagacagaattcttaggctgttctgtgtgatgacttcagattttaaaacaaattataagatgtataagcgcaacaagggccacatacttgttgtttgaccaacaaaacttagtattttggtgaaattagttctgtgttgagtttctgttatttcttatttcaaacccagtttttaagattatttcatgttcatggaatgggatcaaatttggcataacacataaaatagcaatgcagcctcacttagtggtaacacttttgggtctagtgggctgatctttcctggtgtccacatttctgctactcacatctggagttacgttaaaacatgcactccgccgggtgcagtggctcacgcctgtgatcccaacactttgggaggccaaggtgggtggatctcttgaggtcaggagtttgagactagcctggccaacatgggtgaaaccccgtctctactaaaaatacaaaaattagttgggggtggtggtacacgcctgtaatcccagctacttgggaggttgaggcaagagaatctcttgaacctgggaggcagaggttgcagtgagccaagatatgtcactgcactccagcctgggtgacagagcagaactccatctcaagaaaaaaggaaaaaaaacaaaaaacagcgcactcaataggtccagcaatctcacttctagtatatttccaaaggcaatgaaataggtatgtcaaacagctctctgcactcccatgttcactgcagcactattcacagtggccaagacatggaatccacctgatgtccatcactatgtatatgaatggataaagaaaacctggtacatatacattatagaatactattctaccataaattagaaaagaaaaatgtcgtttgtggcaacctggatgaacctggaggacatgatgttaagttaaataagccagacacagaaagagaaataccacatgatctttctgataatgcggaatctaagaagttaagctcatggagagtagaatggaggttaccaggggctgagggtgagggagcagatttggggagatgttagtcaaaggatacaaaatttcagttagataggaggaataagttcaatagatatattgtacatgatgacagtaataatgatgtattcttaaaaattgctgagacaatagattttaagtgttctcaccacacacaaaaaaatgtgatgtaatacatatgttaattaggctcattcagctgttctacaatgtatgcatatttcaaaacaatatgttgtacatgataaatatacaatttttatttgtatattaaaattaattaattttaaaaaagatctccagtagtcacctggtcagcaccagatattctaatctgtttgtgatatctgaaaatcctaatacagacagcaaaagcaggatggggtgaatagaactgcaaatcttgagccaacattttatgtgcctggcactgttcctgggttcaggtttttaggggtaaatggatgtttaggcagataattttgtcaattaaaatagtctgaattgttccatctagtccagttaacctagtctcaccagttagtctatgccacctttgcagcacccagaagcttcataatattcctgcagccttgtccagggtagtggcttgcttgctttctatctttccccagcctccttccctcctctttttcctcccctccatctcctagaaacagatcctagtttgggggtctgtgatctgtgaaacagcaaccttggcttctggggttgagtgaactcagcttgttttggtgacatgacatgttcctgtctgcctttgctgctccatttttaaccttgtaagtgccaggatgccagtgggaaatcgggagtccttctgatagaatttttccagcagatgttatcacgtactgcagggaaattggatctgcgtgctggccttactgttgagaaatttttccttatgtcagacaagactctgtcctgctacagtttagtctcatttcctcttatttaatcctcagaggagatggaaggtttggaagctttcaggcaactgccttccttttaggaactccttgtgtgcctgaatactattaaattactcctcagacttctcttttccagatgaaataatctcaggtcttttggccttttcttgtagcccaatatcatacaccagtttcctagccatttaatcatttttgttattctctggatgtgttccattttctccatgtccctgttgaaatgtgaaactcaaaaagaacacagtacagcctgaccagtagtataagtgatataaacagtgatataagggccttgggggaagaaagaaaaatctgccagctttccgttggtaatgatcacctctgagtgtttttaggaattgcaaaatgctggagcctgcatccattttgagagctacaatatcaataaaaatacttctttcttcgattaaaatacttctaattttaaaaattaaaatagctgtagtagtctttaaagagtaaccatgatcacagttttccatggcaaaataatcattgataggggacttacgattaatgtttacttgatccccagtgattccaggcccatttccacatagacatctgtatttggacgtcccagagaggtctcagattccttgtgccaaaaccaaaatcacagttgttgccctcgaaaggcctcttctctcctttgctccttagctcagtcagtggtcttgtaatccatttgttacccaagccaggaacctcacagcatccttcactcttctttctgttcagccacccctttttcattccaacccaagcctcatggattctgcctcttaaatgtctctggaatccagccctctgtcaccaccagcaccgccacagctcagactccaggtcactcgccttggggggatggtatgagctgtcatactgtatgagcctcatcctggggccatgacttaccaagccagatcatctctgtgagtctgcctggtgtaaagacaaggatcagtgacttctttgtaggtctgaactgggtaatgcagagcatgccctggagacatggcatgtccccccaattctccaagacatgacagtgccttctcttactgccaggtccctccgtctgtcctcagcacagccatttccctggaacgcgaatctgatcagttcactgctgggcctgaaagctttcgctgactccttttaatctgcagaatgagggtgaaactgcttagcttgggctgggtcccttgtgagctggccctgacttctctccagtatcatcattttctaggaaagccatttccccacaacccccaaggaaagcatatcataaacaagttttcccttggggaggttccctcgactcccttctctcctctcccttcctctctgaattgttgccatatgtgaagtccacttttctagttgtcatgctacctgttgacactaatttcccatgtcccacagaatgttccagggtatgggtccatgtgcctggtgcccagcctagcatctgccatacaagtgctggttctgatgatcagtggcttctgtggtcttagacttgtagcaggactcaaatgtctgcagcggcattggaaaggggtgccgtccagtgtgtgcatgtgtgtgtgtgtttattttaaattgtctatggaactatctcaaagattgaggccagcaggacttgacctatacatagatgtagactgtacatagatgtaagaatttctattcattttatgaaaatgaatagaaattttcattctatttattagaaatagaatgcttgctgctgcaagcatttgagtccttttacaggtgtgagatcacaaagaccgcttaccaacagaaccaacacttgtatggcagatgctaggctgggtaccggggacatggaccaaaccctggaacattctgtggaatgtgggaaattagtgtcaaatgtatgcattttcactaacagtcattaaactgcgtacaaagattatttttcttcagtctatcattgaaactattgcaccagaatatactgtactttaaaaaatgagtatatgcctcagtctgcacatatttactcttttttcaaataattgtttgtttgccgtgttctatttctgacaccatttaccttcaggaattcttactgtatgatggggagtaaacgaatatacaggtatttttttcatacttccaactgaatgtgaagaaatgaaatgagcaaattgttcacctggtgatattttatcatttcctcctctttgctgcagcaggatatgaaaacttcatccatctgatcatcgctctgcccgtcgctgtcctgttgatcgtgggagggttggtgattatgctgtacgtcttccatagaaagaggtcagtgatgtgcaaagttatgacactttctgtggctgagtggtttgatgatttgaatgtgagtgaaggtgatatttttgaagatttcaaggaaatattttatggactggaaaacctgattttcccatcaaatgttcttccaggaaaagagaaccttttctaatgattttaacaacagccaaaataatttttcgatggtacagaccttcccctggctggcttttctggtatacagatactgctgctggtgcatacttttccaaacgcgatgcgctagccttcccaatcaaataagcctttttatttccaatgaagtaaagaaacagatgtttcttaaaaagcgctaatctcaggctactgaggaagccagaagatgtgttagcaaatgtctgctggctcacccaggcctgaattgggagtgtagacaagagctgctgtagacagtaagctctccccattctgttctgataccgtgtgagagaggataaatgaaactgttgtagcgaagatgaaagtatatacaggaatgtatggaggtggggttttgttaacgtgaatttaatctttttgacagaaataacagcaggctggggaatggagtgctgtatgcctctgtgaacccggagtacttcagcgctgctgatggtaagagtccgggccaccagcactgccagcgtgcagggcaggtagatcgggagctttcaggagggttgctaatttgggaaaggaaggaggtttgcattattttgagctacctttggccttggatctgtcttcattaatatttctttctttctttttttttttaatcaaagtttttagcagttcagtgaatatgtcaaaacttgtgggactgtatggggtgccccaaggaaacacaggctttagagatgaatgtggccagcgcagtaatcaatttatttaattgcttgagatgttatgctagaatgaaaacagctttttaattgttaacatctagtcagaggatatgctgcagctgacaaaacagtccttttaaactagtttcagcttgagtatcatctcattataattgtctttgatgaattacagctctgcttttttttttatcatggaatttttctgtcattcccttccgactagggtcatacgctcgtggctcattcacattccccttggtaataactaatgagggccattcagttaagtggctgggaaggtctgacatggaagttgggtgatcctcaatggttatttccttttttgctctttctagcatttttatatccagaccttttgagtgagtcggattagggtgaggggttggtcactgagtccagtgatactaggacccttaactggcactttgctaggggcttttacaaacaccatcccatttgtttcttaaacccctgcaatgtgcgttttcttaatgcccatctgcaggtgaggaaatgaactctgggaaaaaacttgtgcaggctcacatggttagacagttgagaagtcaggaggagaatggaatcactgtggaaagggctgtgaggtcccccgggcaggcaaggaaacagccctcaggaggggctggaccggattcatcaaatgaataataaataagtgcatgatgttgagtgagtacatttagaaaaagtgtttgctgtcttcttgcctcgggagaagtgaaagtagatgcaggagatgtgaaataaagagacatgattattctaattattgtgatcaaataagaaaacataagaaaatactttaataatgtgaaaacaccgttatactatgtagggttttactatggtttctttaataatttctaattcagtttatagtaaagtcaatcaaaagcagcctcctctgaatgggaatcaggtgcagaataatgactttatttctatctacataaaggtctcacaaagttggttttttaatagtaatatatatatacatacttctgtagtgtgtgtatataaggcagagagaacattctggacggatgcacaccacacttacaagagttgttacttgtggagaggatctttccctttaaaaaaaaaaaaagccagatgtggtcgaaggcacctgtagtcccagctactcgggagactgaggtgaaaggattacctgagcccaagagctgcagtgagctagaatcccaccactgcactacagcctatagagcgagactggctcttaaaatccagcaagaagatagatatgcattgtttgtatgaataatagcttctaaaaagaaaatcagtaaggaagggagtcatcccagatgatggaattgatagaacaaggcaagaccactttccccctctgtgagggtggactgtgactctacgagagaagctattctgctttgaaatgcggcactagaggttggtgtgtgtagcttttgactgtgaagtgtccaggaagagaaagcatcaatacaacaaattcagattctcagggctctcatggtgacttgaattcacattttgtgtccttctagaatgctttcatgatacgtcttggtacttcattacaacaaaaacaaacttattgccacccaggtcgacaggtgggaacagtgtcaccttatttgaacttaatttattcggcctttgagaagcacttatagccagtttcctcgaggggcaacaaaatgacattgcagttcaaaagtgctttaaaaacttctttttcccaaagctataatctgcatgtcaccattctccagagtacattgaaaatcccctacaggaaagtgctgataacattgtgcacagaaaccgctcctggctggtggcactggggacgcctgcttaaagtcggagccgttgggttgaatcgagagaaaaggattgagcgtattgacttcagggacctcccagggaatgaatgtgattggtttcaactccatgttttatggcaggctaaacagttaattctgattaaaagcaagcctggattctcagagataaatggctggagacagtgaactctttacactttctgaggcgcattgtgaagagccttatctcctgggttgtcttgcatacttactctcctctgacaagcacccgcctcttcttcaggggtgcaagccacctatgccagctggagggcagagttccattcgtgaaacccttgaaacatacgtactatgaaatacaaaaatgtgtaggaaagaaaacaagattattaatgaagttcatattggacacccctcagaggtctaaaatgatggtgcccctcctgggcctaatttataataaacatctctcctttgagacatcacttaaaggttgatagttgggatatggagatgttaggatacagttgtcagcctctcacatccagccacaggcccagggtcagcatctgaaagcatgaaagcaaaaacaggcaccttctccacctcctttctgagccaggaccacctccttcccacagtcagtgtgtggtagagcctggtggcaggtcccgtcaggcaaggacattagcacacagcgtcagaggaattactgacatttcatatggatcttatggaacaggttgattttattttcgtttttaccctacccatttggaggtgtagaattgagcctgtgtttggttttgttttctttctttccaacctttttcctttctttctctttgttttgccttccttcctgcatagaaatatttatttattcattcattcatttttttgagacaggttctcactctgttgcccaggctggagtgcagtggtgcagtctcagctccctgtagcctcaacctcctgggctcaggcgattctcctgcctcagccccctgagtagctgggattccaggtgtgtgccatcacacctggctaattttttaatagagacagtgttttgccatgttgcccaggctggtctcaaattcctgggctcaagcgatcctcccaacttggcctacgattacaggcatgagccaccgcacacggcccatttattttcttaaaccagatcgaatctaaacagaaacagaaactggagaagaaatcctattcaggcttggtatctactgtgcattcctcccaaatctctacccattggtcaaggtccctgagttcacagagcccaggccagagccctggaaacgcctctgcccgtccgctgcctaattgcctgtccacgctgggcaccaccgggtctctccctcagtctcagagctcagttgcttctgcacctcatcagggatccagccatcaaagccaaggctgggggacacttggactagagtaatcctaccaataatgcagttcagctttgtaaccgcaaattttctagtagccgtattttttaaaagtaaaaagaaacagatcaaatgcattttaatagttttttagttccaataatacgtttcgtgtaacccagtatatccaaaatatccattttaacatggagtcagtattaaagttacctaaatatttcacttttttttttttttttgtctaatctttgaaatcccatgtgcatgtctcaaattggactggccacatggaatgctcaggagtcccatgtagggaccagctgccatgttagatagcccaggcatagcatctgtgttgagggccctgacacctcttttggattcatccaagaagtaggaccttacgtgcaccatcatcacctctcatatgtgactctggcctttttcccgacccagcataagaactcttccctctccctactactctcctcctttttacatttgcgttttaatctgttggtgaagatgggtaaaatcctgcttgaccatttcattcagtttctcaatcccctgtggttaatttgtttttttcaaaaatgtgtttttatgtgatgaaaagaaatttttaaaaaccaactgctttctttcctatactagacttccttgctttgttctggtccttctatctgttagtatcctcaaattatcttgaaatcctcagagatctgaaatactagtactgactgtacagttttcttactcaaatctatagcatgtggaaagttgacagcaagccatgccatcgcctcctggtattctctgtgggtttaaggaagcagcatcttatattctttggcttagagttcccccaaagcacgttctgtctaagggcttgtttctgtacctgctttaattacggtttcttctccagtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtaagagaaagttcctgaaaagccaaaatgcagcacagggagagggtatcacacaagcctcccagtatgttcttggctgcatgtacccgtgggtttggtgtcttgcctttgccttctggatagttaccccattacctcactgctaccttcagacccctgtgctcagaccaggccgcagcaccacagagacagttccagacaacacaggcaccagcaagggccaccctgaccctctgagtctttctctttttgattcctcccaggtgcgattgctgggtgtggtgtcccaaggccagccaacactggtcatcatggaactgatgacacggggcgatctcaaaagttatctccggtctctgaggccagaaatggaggtcagttttcatttccaccggtattgcatgttgcctggcctgctctcttttcctttataatctccctgcaaggaaatgctgtgtctttaaatcagtttactttccagcatccagtgtttcttactgcatgctcagttgtaggtcatttatgcaaaggatttccccaactagagtcagactctgatcttcgtgaggggaacttcctgttccttggatcccctctgctaagcccctctgtgcctttgttcctgcattccctccacccccagtcccctccccacatcagtgtccacctgccaagccaggccagcgccactccctccccgaagctttcctgccccactccagtagctatctcctctgctaacttctcgatgcgcttgactcacatcctcgtatgtgttctctctcgttatgttgtgttgtgctgttgttggagtgtgtcccccctccaccccgttgtgtttagcttttcatctcagtccaagtgtgtggctcagggccgcatttgtggcaggcactctgtcaataaatgtatgttacagttcaaggttaagctgcctggattcttgcccttgcatctgggaagttgctgggtgatttcccacccagctccgtgcgcaagatgtgcactcattcataaaccccctccccacacacagtccccttccccggcattgttggcggtccttgtctttgccactgggaatctggtttcctcagactctacgtccacgtttcaggattgatccagagtcagtgtcctgcttacgcttttgaatgaatgatcccacctcagctgcaggatttctgcttagtttcctaaaaatttcactttgggttatgagcttccaattctaaacctgctaaagtcctatgcaatttttcattaaaagtcaccgtggtgtctcccccctctgtagtattaacccacaggccagctttttaacatatgcgggcatgacttttgagtaattaattctacaaataaactgggagataaatgctgagacataaagccagcaagaactgagttttcatttggttgcctccgtgggtctgaagtctttgacccttactttgctgcttactgggtaagcagtgtgtctgcttttattccttagaagcagtgacttccccttctcggcccctttggaaattcttttgctgttcttcatttgggcttaatttttttttttttttaatgttctttgaatcggcaacttaatcatctcccaagtgacagtttcttaattttagttccaaacacctgttcacatatgacttcatgtatttgcagcacatggtgtttggggccaagtgtggactggggcttcaagcaggatggtttacaaaactcccaccctctgttctgccaagcattggtccccagcacccctgggtgttagtgcctcttcctggttcactcactcactttctctggccctctctgtgtctctctcactctctttctttcgagatggagttttgctctgttgcccaggctggggtgcagtggcatgatctcagctcactgcaacctccaccacctgggttcaagcgattctcctgcctcagtctcccaagtagctgggattacaggtgtgtaccaccacgcccacctaatttttgtatttttagtagagacggggtttcaccatgttggccaggctggtcttgaactcctgacctcaggtgatccacccacctcagcctcccaaagtgctgggattacaggtgtgagccgctgcacctggcccttggttcactttaatacacaaaacagcatgaaggagaaaagcttgatgaaataggtgactggagatctggcagagtatttcttgccagcatcgattgaggcacctctgaaaagtccaaaactcactcccttcctctccagtttcaggcacagaataaaaattcagaacacatggccttggtcctggctctgtggctggctgcctgtggtcctcagacagctgctgcaggttcctgggcctcagtgtcctcaatatgaaataagagggtgggacaagattactgaagtccctttcagaactaaaattcacctttagattggtcagatttaaactttttctttctagctcatgtcaggtattaaaatgtgtgcacttaccctgcagtttcattatattcaacctgctcccccgaccaagtttcacttacgtatctcactacgagtaggtgtatatgtatacttgtcttaaatagctctaaccaaattaaaggaaagaatggcagtgtaacaccatgaactgacaaaatttcagccctctgtctttctccatgcttaaagttgagtgcttttgttgattctgttgctcacggcaattataaatgaccacttcataacacatataggtcatactgtaatatttaagaattgtgagcataaactttacatttcatgtgcatatttcctcatgcatcacacgtatctaaagccctgaaaagtagtgatttggacttacccccagtgacttaatgttgcttccccagataaccacgtgataagtgttttaagtcaccaagagacagctttgacagcctgttcagaattcaaaggtttgtgtcaccaagtgtagagaaccaacccagaagtaccgaggagttgttataatgattccaaatactagctttcagtagaaactagcacctcacagggcagcagccagcatccactgggcattgactatgtgccacgcaccactgggcactttctgtgcgtggccccaggtcatcttctcgtcagtgaaaccactgtgataccccatgtggaaaagcctgggcatgctcagctggtggccggcctgcaagtgtgggacctgtcagagccctatggctttgcagtgctgtgtgagatgctttgtggtcaagaaaaccaaggtgtagagtctgttgcacttgtatatgcaaaagtaaaaggtaacattaaaattagggactagtgattgttttaggatggagagacttgggcatgtgttttatataaaacttttttctaaatggatgtattatttaagggtaattctttttaattccaaagccagcacgttgctgtcctctgcaaagaggaatgcttatccctgttacttattcctggtttcctccaagactagtttcagctggacttcagttgccaaggacttgtcttctgtaatgcccacagaaaataataatgccacattgtaaggtgaaaacagtaatcctggtatttttgtattttagaagaaggttgaagggaaagaaaaggattaaataatttataacgatgcttttatgggaaataaaatataccatgtccatttggaaacacatttgcttacttccacacagcctttgtaacgtgctctccttcctcttacctgtacttcggtgatggaaataaaaggaacatataaacaaataggaatttgagtaactgagaatccttactaccaaaaatggcttgtttcactttaaaaaaatgttgccctacccaaaatagaaaatgttggtcctaaagagtgcaaattggtgtttccctcaccagctctgatgtggtcagggagcaagtgcaaataagcttgcggggagcaagcaggtgccatgctctccatgatggtttgttccttccgagcaagtcctggtttcttagcataaacaacccacggtgcccagattgaacaaagatgatatgcaaacctcgaaagaaattggcatggaaaaaaaaaatccaaaattctcatgtgaatttttttaaatctccaacagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggaggtgtgtccttagctttccaggtctgggcaagaactaaactcaggtgttttgaggactttgttggcattagtctgcccctggagaggttttctagtgtgtcccttgagtgcacggactccttcttgggaatgatgtgattgtctccagttgatggtcacaaacctggcacggtcggtcccaatgctgatagctcatggacatggtggttcagatactgggcacggtccctgaggctggctctccagacgtttgaggcatttcttggtagaacacctcttagcattggttacagaaataattaagacaatgtcttcaggagattttgacttgggaataaaactcactgtccaaccttgcattcatccctccaattttcctagcttttaaggagcattgctccccttccagggacccacattggtttctaagaggcaagctgccctaatgacgaagcctctgcacggagcaggagcagtggcaggagctggcatggcagtcccttaggtgagggacgatcactgctcactgggtttcacggctggggctggccagcctccaagctctcgaccactctctcacaacacttactgtcctgctcttagctcaccagcctactggttagactcccttgttgccaccacccactgtcacaccagaaaaaagggttggattgaatttctgagcaatggttaaaacccacttcagcctttaggtttgtgtttttacttcggtcttttaatctgcctaataaaaacacacataacatcagggctgctcaggaaaccacctgcttttaccaggactctcatcttcccactatgatacaatgatagtttagaaaaataccaaatatttatcctgagaaactgcaggggagatttaacacccaaaagaagctatttcaaatggacctctgtgtctagttcttgaactgccttttctggaagtgttcaccttcctttagtaacatatttttttcctttagtagtgatgttttaatgaaatgttttagcccctttggtgaacaatgagaatcttttagagaacggtttctttttttgagacagagttttgctcttgttttccaagctggagtgcagtggcacaatcttggctcaccacaacctccacctcccaggttcaagtgattctcctgcctcagcctcctgactagttgggattacaggcgcgtgccaccacacccagctgattttttatatttttagtagaaacaggttttcatcatgttagccaggatggtcttgaactcctgacctcaggtgatccacgcacctcggcctcccaaagtgctgagattacaggcgtgagccaccacacccagctgagaatggtttctaaagtaggggtgagtgtctttctttttactctgtaggagctagaggtattgaaatggaaccatatcccagagcccacatccctccgtcatcagagttcctcattcaggatccaccagtgtgtccctaggtttggcacgttgagacgtcctcacgtttggtgctctgtgaagctgggcagccctcagagaggcaaagaagtcccaagaggccgtcctgcctcagggctctcaggaaagagccgcccgcgtccctggctgggcttccttggtgcacccagctcatttctccttccctctctgtagaactcacattgtccccgtggaaatgccagccagctcccctttcccagtgcaggggggagccaggtgggcctgaggtgggccagttctgccgctaatgggtgagagacttgggccaggtgccttacatccgggagcctcagtttcctcacctcggaaatagggtgataatgtaacagaccccatggggttatgagaaggacttggtgcaggaaagcagcagcacgtgcctggcacagggcagggcctctccagatggcagttcctgtctgtgtcttattcccaccctccgggcacatggggggaactcagtttctccccactgcgcgtcaccctgggagaggtgttttttgtgccaattgccattttaaatccaaatcagcagggatcatgtttgctgttcaaccatgtggcatatttatagtgattttttttgtaatcatggtttttctttctggaatttcaagtttttcatttgtgctgaggaaggtcgtttgtgttttttaataggattccttcttttccaccttgtgcaagtaaaggcaaatcccctatttgcatgtcactgtattaattcacagataacactttcacacttcatttttattcttctcaagggctcaagatgttttcccaatgcccagcgtctcatggatgacaaatatgacaagtaattttaccagaggcagtttgagggctcttagcatagcacaagtaaattatgttggttcaagtccaaggaactttgttctctttgtgtttgcttttgtagccttacctctttggggcatgagttagagacatacatgagcattttaaagtggagcagccctttctcctgggaaggagaacggaagagtccacttaagaaaaggttgtatgattgagtgcaaaatcaaaatctgacaaagcagcaataatttaggattataaagcgagcctgccatcaaacataattatgtggcatcttctggagacatggaaaatggaagaaattttcaaaaatgagtgggaggattatgttgaaaaacagtattgagtaatagcttcaggggcctcgtaaatagcatcttttcggcatcttactgggtacttttgtcatcatgaattgttaccctgaatattttcccccttattaagcagtgaaattatttacttttctccagtggtggggcagtgctaccaagttaagtaagcatctgtactctcctgtttatttggtcaggttttaaaaccatgtgtaaatgaccagtggtctctgcagtactatatattttcttaaattgtgggactctaatttttacaccgcttccttttttcttatttttattttcaagacaggttctcactctgtcacccaagctggagtgcagtgttgtgatcatggctcactgcagcctcaacctccagggctcaagtgattcttccaccttagcctcccaagtacctaggaacacaggcgcacaccaccactcacaactgactaatttttaaaattttttatacagacagggtcttgctgtgttgcccaggctgatcttgaattcctgggcacaggcgatcttcctgtcgtggcctcccaaagtgctgggattacaggcgttgagtcactgcgctcagcctgcctctcatttaaatgcaataagggcattaacttcctaagggaatcaaattgtaaatatattaaaagtggagattgcttggtatttgctcatcatgtgattaatcatcccttactgtctccaccttataaaattgcaaaccctaatatttggccaccttaaagtgggacgtgtctgtgtcttgccttgcgtctctccacacataatgagtgtagggtcctctgctgtgacagcagtggtgcctgctccagcgtgtgactctgcgccctctcttcccttacagattttggtatgacgcgagatatctatgagacagactattaccggaaaggagggaaagggctgctgcccgtgcgctggatgtctcctgagtccctcaaggatggagtcttcaccacttactcggacgtctggtatgagaacctttactgcattgccagcctggagcccccagcctctgcactttccaccagctcagtctctagggctttatctttctctgttcattgttacccgttgccagctttagctcagtgttgtgtgagccacacttcttcatcattgaggtgttcctgttgtcagtgggctagctaagggcagaagggcattcgtgggattttaaagaatttatgggaccaacattctttccgccttcagcagataccgattatgtttccaggaggtgggatgtgccagaagccgtcacctctttttgtttctcccctgcctgccttctttctcttttcctctttctcaataaacagatactgtctgtgtgtctgcctcacctaatctaaccctcagattgcagacagtgctttatttagacccaaagcttatgagtcctgattgtgttttcctgctggtcccatctgctgtctgtctttcagtgggcatccaccgttgtggacccagggatggttatgggaagcaaaacgtctcccttaatcataaacagtgtctaccagtggaagcccatcgaccgagggatcagaggcctctcagtagtattgtttattgcagttccttggcaacattgcagagaggcagtcaggttctgaaatacaactgaggttattggcaggctgaggccctggcacaggcaccttctagaatatcagctagtgtcttggctttcctctggggggatcccgttgctgttgtgttacagaaatggtagttgtttactccaacagtctggatgaccgcatagaggaactatttcaatagtgactgacatcattttttttttaacctcgtaaacctttcacagttcaggggccttggatcttattttgaagacaggtgcaaattggaaatagcatttgaatatgacccggcaaagcatgattgcttcttaagctcaagtatgagatctgttttgcaatcagcttgtccaagatggttatctcttcactgtcaaatcaaagtgctctgcatggtgtttagagattgggatggtgaggagagagcaagcctgggtatgtgcatgcatctgtttattctaggcttcgtgcctccaggagcttggaggtcagcttgtagtataataaaatagaaaactatacagccggggagaacagaagcagaatagaaggataaagtgttgttcatatctctcaggcaaattttacccaaattctgacgagcagttactgcacaagcaacaacaaagggacctagagtgtgttcattgccaattctgtccatttggctacataactactgtgaaccaatacaaaaagatatgtataaacatgaataggcgtttggtattcattccatgaaatgctcaggcattgacagcgcttcaggttttgtttgctttttaacacaggctttgaggatagcacaggtcaggaaggctagggcgttggagcaggtttctcagcggtccaggctctaaactaaagctgtccctctcaaaagaatggaaatgatttcagattgtattcagcagcacgaagcaatgattcctaaatagttaaaaatctagaaagaaacactaagaattgtattgggctttgtagaagagaccccagaattttaggatttgggatgtatccctgcagtcaggcccagtccccagtgcacctgcagatctttgacagctgctggttgagcttctgctaagaggtttccttccagggactccatgttcactgcctcacaaaggcaggccagcctcatgctttagacatccttgctcttaacaaatctttcgtgttctgctacgtcagcctctgtgtgacacccattggaccttctctctgtagcacaattgcataccttgctctgttcttgataagataggtctaggagtcatcgaagaggtgtgtctgttctagccagaacacctccaagtttcctgctgtcttccaggacttcattcccaggcccttgggcactgtggctgctctccctgcagctccctgtagcaccatgtccctctgaaatgacaagggtgccctctaggcatggaggaaaccagacgaaggactggggagctgcaccccacagcctagagctgtgcttcttcccgagcatctggatcacccaacacataatctttattttttattaagaagctttccaaatagtcacaaatagccaaggttatttgcttctttcatgactaattaccatctgtggggaatgtggatttctctgtaggttttaatttgctggtgagtgggccattgctaccatcccctcctggtgtggggaagtatagttactgaatgctgcctccagccagcacgggcattgcagggggactcacagccgccggtcttccccctggggaaacaacgtcaaggttcctaattagaaagggctttacacagagacatgtatctactgtttgaagattaaatctgtccatgaaatggaagacttgattttatatgaagtcatgaagagccaacaccacatagtaaaataccggctttgaaaaacacagaggtgttgcatatttctcggtgcttctgactggctgtgtggccttggttaaacctcagagcttctctggccttcggttgctccatctgtaaggcaaggtctgtctcgagaagtctgcggtacctgaatagatgttgaaatggctcctgtggcaactggtattgtgtagagatggttcagtgtccacaccttgcagttgtcacattaagctgtgaaggacgactgactctagcactcagtggtcctcagtggcaggtgatgttgacctcagacaagagttgctcaggagataggctttgcagttcacctcgacaagcgtttgtggagagctaggtctgctacctcctgtatcgttgcctgtgggtgatggtaaggctcttgggggtgtggaagatgcggggatgatgatgatgacgatgatgacgatgacgacgatgacagcgtcgtcgtcgtcctggtcctggaaggataaagtcttgtggagaagaggaggcaattctgacagtttggggttgcatcatcttcttcacagaagagatgaagttgtgtaggcaccctaagtatggattgtcacaaaaagagcactaggaagcggggcggggcggggcaggggtggggggttcctggcagtgggaatgctgggcaggcatggcagtagggagcacctgctgcaggtggggttggtgaggtttcctcgtgggacttaggctgcagagagatcaagacaggcctcagctgttgtattaggcatcctggactaattctttaagccctgttaaggtttctgaaccagagggtgattagagctgtgcttgaagttcttgttagccggagtatacagctgcattgagcaagatgttgtaaccaaaggagaggtggtggtgggccaggcaagcaggatcctgcacactcagggagctctgagggacggaaggagggtgccagaccttggacagatgtgagcctgggtggacagttcgcagtgggactccgaggaggccaagggcatgggtgacagcaggcagactgctcgggtggaatgggcatcagctgcagggaagccgggggaagaacagggcacaaatcagagttcagtgtgagacgcagtgagtttgtgggtagcccagtaactgggaacttggaatggagcagttgggccgggagggccagggtgggagccgtgccgtgagaactggctgcctgcaagccgctgacacagccaggaagggcacgtggggcaagaggagaagtgggtctgggagggagccacatcctcaggccatttcccagaccagcctgcagtcagcaaaagcagagagctagtcatttcttcttattttatttttaattttttgttgttggagagctagtcatttcttgtaccaagctgcatttcagatgtgtgggtactactgccactggcatctgaggcatgctgcctgtatggctgggctggttgtggaaggcagagcttcccgcacaaagctgatggagagccccttctcccctgggcccaggcctctctaaactgcacttttggcctctgggtgtcttgtacaacatgaagacgacagcatttcttggtcacttgtaattaaaaaggaccttgggttggtctgtcctctgattgctaagattctatttctgtctaacatctacttttagtatcaatttgtacaaaaatctttgattcaccgaaagtagctgaagcagcgaataaaacgttctcatacagtcaggagcactgtgggcttgggcacaaggtcaaggtcccaagagctcttggttggaaatctcctgccccaggtttttccatgtggcttgaccagcacctgcagcccaggacaggtccagctagaatccctgctccccaccctgctcccgcccctacttggtgatgagtagcctattttactccaccaaagtgaaccacatggaaaggcacacaggtcagggagaatttgtgaattacggaatttgccctgggagggcacatttgttttgcagattccagcattgtcttttttaacattctgtctgaaagttgtgtgtgtactctctgttttgttttccagtggtttgatcttctaaactggcaaagctgcatgcatatggcagaattgctcactacaaagttattcctcagccaacttctctgcttaaggattctttgtccatgataccccctcccagccagtgcagcccaccctggtccccccacctgtgacacagaggccctgcaggccagcagctccccagctctgttgtgggtgggggagcagcaggagttctcttctcccttggcccaactggacctcaagatccctatagatcttctaaacattccaggtcccaggccctcaccccagaccaatcaaatcagagtttctattgggtgcccagccctctgtttaaaaacctccccaggagattctcctgtgcagccggcagtgagaaccacctgggtagaggtttccaaaattgtctgattgtaaaaatcacctgaggagcttggtaaagcttgactgtcccaggcctcatttgaggctactaagtcaatgtccaggctggggcttggacaagaatgtcattctttttgggtcaaagccaggttaggtgataccgccttgccagataaatggccgggactaggtagatgctgaacccagtatgctctgcgttcaaagcacagatcaggggcttcctgaccgtgcaagggatgccggaagcgccctcaccaccttccttagctccaccaccggggctgaatttagtttacggggaacattagcagcaacagagggaggatgatatcccgcacttagcccagggcctggctcgctgtctgacaagcactgtcaccatagtaaggacagtttatctgctcgggatgtaagaagtgctggaaaggagggggcagcattgttcagtccatccctttccaagctcctcacagtttttttctccctgtaggtccttcggggtcgtcctctgggagatcgccacactggccgagcagccctaccagggcttgtccaacgagcaagtccttcgcttcgtcatggagggcggccttctggacaagccagacaactgtcctgacatgctgtacgtacttcctgggccctccgtgctcttctgagttctcttctcaaatacctgttttcttgggtcacaggagattaggagattaaagccattctctctggtcctgcacctcccttgccaggcgtggctaagaggtttgtccttgtggaaggagctgagtgggttggtcgacctgtgcttttccgtgggtaccttaattctaccccatattccgtaatgctttcgttccgatttgcagttcacactgtagtttctcaggccaaatgtctctgtgaaatgtttggccagagtaatccatccttactcatcctctccatgtgaggtttttgtttctttttaaagaaggctacaacacaacacatactactctgaagtcgaattcaagagccccgcgccccacctgtggcaggcctgagggagccgccgcagtgagtgtgcacacagctgcatggccaggactccggcatgcaccacgtagggtcagcttggtgtcttctgaaccctgccccacatgtcttctctgttaagtgtttacaaaagtcataaaccatctaagtaacatgctctccggagcttcatccgctgaccaatgtggacctggagcgtgtgtgagctgacatccctgcggacagaaggatgccagtgctggtgaatttgtcttctcactgcacttttttttttttttttttgagatggagtctcgctctgtcgcccaggctggagtgcattggcgtgatcttggctcactgcaacctctgcctcccgggttcaagcaattctcctgcctcaccctccaaaatagctaggattacaggcacccaccaccactcccagctaatttttagtagagatggggttttaccatattggccaggctggtcttgaactcctgacctcagatgatctccccgcctcagcctcccaaagtgctgggattacaggcatgagccatcgcacctggcaaccccacttattttgaaaaaacactttgcagcttttagtcctaagttttgtcagatgacgagagagagtttgtgatgcctcacagtgttggtgaggcctctctgctcagcgccccctggagaagccccccttttggtggaggacttgctctgtgtccgtggacggtgctgttttgtggctcagtggaggtcagagctgctggagcagggaggccttgttgtccttcctggaatgagtttgaggagggggtgaaggtgttccagttcagtcatcaggcgcacaacaggtacaggttgggagcagtggccttgcttttgacatgcactttaaggcaggcttcagagattgatctggatctccatagctgaacaggaaggtgggctcccactagtatctcaagaccaattcaggagatttccagaaatgcttttcaggacaggtttggcttcattttggaaaggatcctgaggaattgctgggctgttatgtctgcatgaaggcacccagctcctatctctcacccatccacccccctggagccagcacagactcaggctgggcccacagtggcgggataatagatagatatgaaccagacatgtgtcaggtggacaggagggaatgagggctccagcagccacaaaagttttgctcatttggtctcctacagtgtctgtgggccaggaatccagatgcaggtgttcttgctctcagctcagagtcacaggaggcagaaatcaagatgtcagtggggctgcagtctcacctgaggctcagggacatcttcaggctccttcagggttctgcacttgcaggactgaggtccccatattcttggcacctgtcagctggggactgctttcaactcttggaggccaaggccactcacagtccttgccatatacagcctccataggccctctcataacagcagcctatttcttcaagactgataagaggacagctctctactgcttctactggttttttacctgataaagtcagatctacccaggatactctctcccttttaagtgattcacagtcaattgatgagaagcctgattagaggagtgaagtatcctctcatgttcacaagtcccacccgtactcaagtgaggggattatatgggatatttacaccaggggcaacgatcttggggggcatcttagaattccatagtctcagaaatcattgtccctaatcaaacaatcaaggtgctatttttgtttcaaagcactttgagtgttgctacaaatactgaatccctaagctccttgtaaatggccggccagcggagggcatggggtggggaagactggatacacacccctgtgctctgggagtacgttggctgggcggcatgctcattagctgctgcttccgaacataggttcagctgaagtgtatcccaggcagtggacacttcgtgtggaattcagaaaggtggcgcaggaaggataccagggaaagccagagtgaaggcatcacccttgcacagctagcacatgtgggggctcccattgtcccatcaaggcagggccagaaccagaaagtcggctggtgccctgggcctgggccagtgatgggaggctcctcttctctgagggtggcacctacagatgcagtggcactgggtttcctggagccctcatcaaggaaacttcccagcatggcctcttcagaactccacaatccaaacttggaagagactcgaaagaccacttagtaccttttcttgcccagtatagaaattcttcttctccccttctgtgttagttttttatcgcagtataacaaactacccaaaacctactagttaagagcaacagtaaacatgtattatctctcagaggtttctgaaggcgaggaacgcaggagcggcatagctggctggctctggcttggagcccttctcgcggttgcagcccagctgtccgccggggctgcagtcatctgaaggcttgcctgggggaggcagacccacttccaaggtgttgctgcataggtagtatgccctgcatgaatcgccctgttctacgtgggcctctccgtagcactgcccaagtgtctcaggatgtgtagctggcttctctgagtgcagagttcggcacactctttctctaaaaggccggctaaaaaaatgtttttggctctgtgggcccatacgaccttgactgtgactactggactctgccactgtggagcaaacacagctgtgggcgtcacataagctagcgtggctgtgttccaatacagctttatttttaatactggaatttgaattccacatcatccctgtgttgtcacaaaatattcttattttgaatttcttttagccatttacatgaaaaccattcttagctcatagaccttggaaaactaggcagcaggccagattttacccacaggtacatagtttgcctgctgtgccctagagtaaaagatccaggacctgagcagaaggcacgacgtcctttctgaccaaacctcagaagtcacactgaggctctcaccttctccttcaggttacaccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttcttgccagccattatgagaaaaatcatgctttcaagtctgaatataagccatggagtaagaggtctgatgaccactgaatctgcataaaggtacagtgctagaatctaggctaatactagaactggtggtattttagcaagcttagaaacagcccatgaaagcaggtgtgagttctgcttctgtggtttagggtgggtgagggagagcggtattgttctgtgctttctctttgactcgggtaaacgtttatctacaagagacttgtgggattcttacttggtccacctccaggtgactgggcttttactattaatgtaaactgcctgggacgcagcccctgccatgggaaacgcagggcacttcctgttctcagcatagagtgacaaggaaatttactcagagcggttactctgacattcaatgtttagttcaggaggcatttctgctttgccatcgagaatttttctcccttctaagaaaatgttttctcctgagaaaatttttctcccttccaagaaaagagtagaatgaaaggaggcaacttggtttcatagggagtgtcatgttgtccttctgagtttactgatgagcttacctgagaaaggagggttctagcatgggagttctgttgctacaagacatgaaagaatggcctccgtttatcccggagaggagagtccctgagcccttgggagttgccttgaaacctctgccgggtcccaggtgagaaagtgtgtgagttgtgtggttctgagatctgaacaggcaccatctggtgacactaggggctgaaggagctcggtggctgcaggtggactggagctcaccatcaggaagtagccagattctcacccctcagtgtcaccgagtgttctggctttagaggaaggactccgtggtccccaagccacaaggtgtcgaggtctgagtctcaacgccatgactcagtgtgaattaacttagcaggtatcacaacatcagatttgggttgtggttccctgctgggtctgtactttagattgatgacaaagcccgtcctcagccttatttcagcccagatctcggtatttatgccacagatactgttgagctcctctgggtgcgtgctgaccctgaggtcacacagatgagccaggagtggccctggctttcaggaaacgtagtgacgtaaaaggtcccggctgctgcgggataagggccagggcagaggtgtgaacgcagccgtggaagacttgggccaggaagccatttgttctgctgctaacacttccacagctccacgtgtccagactgttgccagagacgtctttggtctacaggattcaggagggaatctgaactttagcctggagcattatcaactcatagatgagtctgaaacaaacttagtgaaatctgatgttttttgtagttttccagtacagtttttcccatcgctggaatcctggtttggttctgcgggaatcgagtgcttgagtgggacccagacagacaggaagggcgctcctgctcagttagccccagtaagctcactgaggcacacaggccccatgtccacagccgctcctggctgaggcgtggttcctaagacgacccttactgttgagggctgccaggagggagagacacattcagccccgcaggtcctctgggaatccggtgagcgtcggcaccgggctggggccgtgctgattcccggcagcgtgtgggaatgtgcgggtgcctcgtggcctgctgacatcgcacacaggtcacagcctgtccagttcaggacatcagggccaagagtgaagtgagaatacggaggcacctctgtgtgctcaccctgctgaccgtcacccagcctccggggggggtcacagctggcccccaggaagctgcttcccagcagggcaggaattccatttgagtcttgtccctgttccaggagaagggctgggtatgtgtcccccaaaggggagagcattcgagaaggatggcgccagcctccccagaactgacctgtggttaaaaaaaaaaaaaaaaattgtgctttttaaaagatgagttttatcagctcacacatccttctagagtctaatggagattttttgtgtgtgtggaaatagtaaacaaggtcttgaatcccacagagcaaaaaagacttcctttcatgggcagcactggaagggttgttactctggaatggtttaaaagaggcgtcacatggcttgtttgtgctgatgtcactgcctcgctgctctcctgtggcacctcctcggtccctggccacagggcacagagccaagcacatctcatgctcttggcccagttacgcttctgcccaggggtaagtcagctggagaggaattcacagcccaggcatttcatgtcgttatggcctattttaatttttttaaccccaatcatttttcttaggaagtgatggggagtttggaaaggcaggcttatttgtcatcaagctgccagcttttatcaatgcaaaccacatccctgtgacatctgtgactgttccttggacagttaggtgagggagggtctcctggtggccccagggttactcttatttaggttgagaaaaattcctttttccaggatcgttggtgatcaaagtgtagtcattctgttgcgcagagaactccatcccagctccaccctcatgaattttgtaatcttggacaaattatttagtatcttagtgcttctgttccctcatctgtaacatgggggtatattatagtcagtagcacctgcttcacaaactcgtgaggacttcagcagttcacacacataactgcctcgctgcctggcacctagcgtgcacatggcattctaccgtggggtagacttttaaaattctggctacagagatacttttccataaaagtggccacatggaactctccaaatctaagaagcatactgtgggggccttcatattttgtctaattcttttctccccagaacaggaacctgcacccttccttcttttaaagggcgacgtggtaaataaacatttttagacttgcaggccacagtctctgtcctaatgtcctcagctggtagttgtagctggaaagcagctgcagcccacatggaaatgagggagcgtggccccatgccagtgcagctgatgtagaggcgggcagccccgggttaggccctgtggagacgcaggcccccgggctctagaacgctgaattctagtgaattctggatggctctccctcacacccaggcccaccctccctcaaggttgcaccttctccacctgaaggaagctgccaggtggccataggagcccttctcttggcaggccagcttccaggcccagtggcttctcttacatcaggggcctccccttggaatgttccctgaaggccagacacgggcaggtagtctgtggtcaagcagccaccctgacaggaggctagatgccactgggtgtgctttgagtttcctagatgtggagagttctgtgtggccacttttatggaaaagcatctctttagccagaattttaaaataaagaggataacttcctggtgagaacagacgtggaaaggaaggcactttggtttcacgctcatgtaagagagggctgttggcggtcactcctcagaactatggccagccctggatggtagccagctgctttttgccccaaaagtctgtttagctgggtctctgcattctggaagcttgtcaaagcccgggcctttcctgggtcagggcagccggctttccttgtccacgtgtggccggctgttttcttggggagccccggccacagccggcaggactccctttgctccatgtgactctgagggcctcacaggtatttgcagcccaggtgctgtcggagcccagccgatgctaccgacacacagcacaagcgtcatcctgttctgcctgtcccttgcgtgtggaggggactcgtgcccagggctctccttgctggcttgttggaatctggcttcaggtctacacggggcctctcgtttggtccagaacagcctggctcatcggctggggcttgcttgtgcagggctggagcgagcacgtgctagatggagacagcagactcggagtgtgcatttcttcgtgttgcaagcctggcctcacagtgccttcttcctttggttgtctgccaggggtagccctgcaccaggaggaagcttagaaatagcacaggtgggaaccggagagagagcactgttggggaagctgcggtcactcatcagccttcctggtgagaaaccaggggtttcctgctaattctggaaaggatgtttcagcagtgcctgcatgagacgcctcagatagaaaactggttatttttgtttcttagcactgccaccatagataacagctgtcacgatggacagtgtggacctggattagtccttcttgggaaaggagagtttgggttttgtaccgtggtggttctgggttctgggggaagagaatggaaccgtacgaggtaaaacaggagactctgaaggccacttggccatccaggcagaaagccagggatggagaggggcagcagggctgtgttcagtgctcccgccgtacgcttgtatgcgggaaaccactgcaggcggcccatgaagcctcctggccatgtgcgccctcccggtttggaccccctcccgtgtgtcttggctgcaggtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagtctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaggtattatatgtaggagttttcttttaatttattttgtgataaattaccagtttcaatcactgtagaaaagccccattatgaatttaaatttcaaggaaagggtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttctcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttctgagatgtcctgttttg

SEQ ID NO: 35 - DNA, 144034 bp, Human
  misc_feature (1)...(144034): n = A,T,C or G
ctcatctcttcttcatacttgataaaattctccccaaaccttgtccaagctttgaatggaacagtaatagtattacggtaaggtggtctcacctcacttaccttcaggaaaattccatatttattagagcccacatcaaagtagaaccttttattgtccactctgaaagaagtcccctctgggagttcaagcgggtcatcgtctccacctcttcgttcttctatgtctccttcgccatagtcttcaatcagctgaaccaaggcatcacgaaactcaatcattccttgtgctgggaggacaatagtctgttcttggcccaaactgtggccaaaataacctatcatgccagtcccccgcatcatggtttgtctaatccgtaggaagcgaccccgctgattttcctttaggtctaggtaatatttcctattgtccctctcgatatagtctgttttcaggacactgtgaggatgctcttcggaccccaccgagactggtggggagggtgccgagtgcttctgcctccttctggagccttgctctttgctgtggccatgctcttgccggtggcctttcaggcccaggtgggcatagtgctcgatgaagtcccctagacagtccttcagctccgctgccacagacagggagagggtcagtttactctttctgatgttgtcctgccggcctctccctatccagacttcggctatctttaggaagcggccccgggagctttgcttcacgtctaggtaaaacctctttttctggatgtccactcgtttggaggccagctcctggatttcggctgcgcccccggcctgattaggggtggctgaggccgcgtagtgggggtagtgggagtgctgggcctggggatagagtctactcttgcttaggccagagccccctacattcttgcctccgcggccgcggccgccgccgcctccccttcgcctggctctttccatcttcagctgcaagtaacaaacagacacacgggatggggtgggggaggggtgttgagaacaatcgcagacgcccctcggcctgaccgccccgccgccgcccgcgacccccacgccgggcccggctcccccggcgccgcagcgcggggctccagccactgccggccggttggcggccgccgctccggctctgcccgcgctccccgcatccctccgccgcccccggggccgctcccgcacgccgccgccgcccgtcccgcgctccgcggccccaggtctccagccggcgggcactcacatcatctctgccatcaccgccgccgccgatgcccttcacgaccaccgccgccgccaccgccagctctcggcccctctgctgcagccgccgcagccgccgccccccgcctcctcccccgccgccgccgctcgcactgccccccgccggagcagccgggcaggggcatcgcccgcggcgcccaccgcagccgcccctcctgcggccgctgcgggggccgccgcctgacttcggacaccggccccgcacccgccaggaggggagggaaggggaggcggggagagcgacggcggggggcgggcggtggaccccgcctcccccggcacagcctgctgaggggaagagggggtctccgctcttcctcagtgcactctctgactgaagcccggcgcgtggggtgcagcgggagtgcgaggggactggacaggtgggaagatgggaatgaggaccgggcggcgggaatgttctcacttctccggattccaccgggatgcaggactctagctgcccagccgcacctgcgaagagactacacttcccgaggtgctcagcggcagcgagggcctccacgcatgcgcaccgcggcgcgctgggcggggctggatgggctgtggtgggagggttgcagcgccgcgagaaaggcgagccgggccgggggcggggaaaggggtggggcaggaacgggggcggggacggcgctggaggggcgggtcgggtaggtctcccggagctgatgtgtactgtgtgcgccggggaggcgccggcttgtactcggcagcgcgggaataaagtttgctgatttggtgtctagcctggatgcctgggttgcaggccctgcttgtggtggcgctccacagtcatccggctgaagaagacctgttggactggatcttctcggggtaaagtgtcttcctattcccgttttcccagctccgtgccccggggtatctatagtgctaggcttctgagacacgtggaggcgcttaggcccgcggagcaggcccctgggctgtgtttgggagattctggaaaaacagactttctcccttttcctttcccctctggagcagctgggaaaggcgtctctcggagcttccgccattcagaaagtgtttccccgcccctgacggccccagcttgatgtttaccttgcgcgcttagttaggattgctctttctagtacggcctttattatggcagaaattgagccactacaggtctgcacagcaaagtcgagggaaataacctgctgtctatgatttagcaagtgatgatggatatttttgagttcaaatcactcagtctttaatggattttcttttctttttttcctagttgaatctcagttgttctcaggctaggtttgatatgaaaaatactactccctattgaagagggtaatataattcttaggatgctaatacaggagtctgtaagtcggagtacttcaggctttttatggttcggtacatttctttttaggggtgggatattgggataagtaggacagttcagatcttgatgtcattgaatagtggtgtctacctaaaaggaagaggctggggcacaaaattataatttaaagtgtttacttcagccaaaatgaggacagctgcccaggactcatttcccagttgccttggggagtgctccttcagccttggttacaagcaggtttttaaaggcgaaggggaagagtgggctgagacaaagttggtcaggaattgttattggtttacagagataccattgcttagtgattggctgtacactgtaactcatagggtatgagttatcgtgtccagcatatggcattttatggcttcttggttccagtctagagcccatatagcaggtgggctttaagagataattatccagctcagaccgggagtgagacgggactgttttttcattctaatgcctctctgggcctgataatttaaaggggcttgcattcttcagctaaaattttattttcttttattttttttcccccacagtggtctccctttattaatccaacaaatgtttattaaggactgctctaggcactagagataccaacaatgaacaaaacagacaaacatctctctccttttggagcttacattttagtggaaagagacaggcaaaaagtaaaattataggatgacagaaggtgaaaatagagattaaaaaggaaagggggatgaagagtgtgtgtgtgtgttgtgggtggggggctgtagggagctgcagttttacaataagtggtcagggacgtcctcgctgagaagggaatttttgagtccagagctcaaggaagtgagagaacttaccttgacgttctctggaggagaagaaagtacaaaggccctgggggaacctgcctctttatgttcagagagcaacttaagaggcctagtgagctggagcagagcggagaggaggtcagaggtcaggccagaaagggaaaggggccagaatgtgtaggactttatgggctatattgaaaattggggctttcattctgagggagatgggaagctgttggagagttgttagggaaacgtgatctgaattatgtttctaaaaaattggagtaagatatcataaaatttgccatcttagtcttttttgtatctggccaattccactcagaattcttttttaaacagctttattgagatataattaatatatcatatgattcactcatttaaagtgtgcaatacaatggtttttagtttgtcttcagagttgtacaacctttatcacaattacctttaggactttttcattacccaaaagagaatctccataaccattagtactcaatcccacccgctttcctagcaatcacttacctatttttttgtctctatatagctctcaaaccctatgatattccttctatctaactgtatttttgtactcattaacagcctctcttcattcccaccacccatccatcccagcctctggtaatcaccattctacttactacctcaatgacatcaaattttttagctcccacatataagtgagaacatgcgatatttgtctttccctgcctggtttatttcacttaacagaatgtcttccagttccattcatgttgctgcaaatgacaggatttcattctttattatggcttaatactattccattgtatatgtatatcacattttctttatccactcatctgttgatggacagttagcttgattccatattctggctattgttgaatagtgctgcaggaaacatggaagtgcagatagctctttgacatactgatttcatttcccttgaatatataccctgtagtggatttgctggacccgcttgtagttctacatttaatattttgagttatttccataatgttagtaataatttacattcccaccaacagcgaggaaggagttcccttttctccacatcctcgccaacacttatcttttgtctttttggtaatagccattctaacaggtgtgaggtgatatctcattgtgattttgatttacatttccctgatggttattgatgagcaatgtttcatatacttgttggttatttgtatatctccttttgagaaatgtctattcaggtcttttgctcattttttaaatatggttttttaatttttttatttttttgctattgagttgtttgacatccttaaacattttggaaattaacctcttattagatgtatagtttgcaaatattttatccgattctgtagattctgtcttcagtctgttgaatttgctgtgcagagaagcattttattttgatgtaatccctttgtctatttttgcttttgttacctttgcttttgaagtcatatccaaaaaatcattgcccagatcagcagtccccaacctttttggtaccaaggactggtttcatcgaagacaatttttccatccacaggagggaggggatggtttcaggatatttcaagcgcattacatttattgtgcactttgtttctattattattacattgtaatatatagtgaaataattatacaattcaccataatgtagaatcactgggagccctgagcttgttttcctgaaacttgagggtcctatctgggagtgatgggagacagtgacagttcataaggcattaggttcttctaaggagcatacaacctagatcccttgcatgcgcaattcacagtaggttttgcgctgctatgagaatctaatgccaccgttgatgtgtcaggaggtggagctcaggtggtaacgtgaggaatggggagcagctgtaaagaaaaatgaagcttcgcttgcttgcctgctgctcacctactgctttgtggcctggttcctaacaggccatggactggtactaatctgtggccctggggttgggaacctctagccctgaccaatgttagggagcttttttcctgtgttttcttcaagtggtttcatggtttggggtcttacatttaagtctttagtccattttgagttgatgctgtatgtggtgagagataattgactactttcattcttttgcatatggttatcagttttcccaacaccgtttattgaagagcctgacctttccccattgtgggttcttggctcttttgtcaaaaatcagttggctataaatatgtggttttatttcttgggtctctgttctgttctattatctgtgtgtctctttatgccagtaccgtgctgttttaattactagagtttagtatattttgaagtcaggtagtgtgatgcccctagctttgttcttttagctcaacattgctttggctattcagagtcttttgtgaggataatgttttcaaggttcacccatgttgtggcatgtatcagaactcgatttctttttatggctgaataatattccatttgtttatattatatatatgccatatttatttattcatatgttgatggacacttaggttgtttccaccttttggctattgtgaataatgctgttattaacattggtgtacaagaatctgtttgagttcctattttcaattcttttgggaatatacctacgtgtggacttactagatcacatggtaagcttttagtttagctttttaaggaactgctaaaactgtttttccatgggagcagtgtacaagtgttccagttctccatatgctcaccaaaacttaatttccttttttaaaaattatagctatcctagtaggtggtgggaagtggtatcttactgtggttttattttgtatttctttaatgactaatgatgttgagcatcttttaatgtgcttattggccattatatgtcttctttgggaactgtctattaagtcctttgcccattttttaattgagtttttttttctgttgaattgtgggagatctttatatattctgaatattaaacccttattgggtgtatgatttgcaaataatttctcccattttgtgggttttcttcactttttgatattgttctttgattcacttttaaatttttatagagtccagtttatctgttttttcttttattacctatgcttttggcatcatacctaattcccaaatccaatgccatgaagattttctgttatgttttcttttaatagttttatagttttactttttctattggagttttaagtaaattcttgtatattagtgtgatacattttaagttatttttgtatatggtgtgaggtaggggtccaacttcactcttttccatatggagatccagttgtcccagcaccacatgtttaagagtctattctttccccactgaatggacttggcacccttgtcaaaaatcaattggtggtaaatgtatggatttactcctggaatctcaattctattctattgtatttatatttctgtccttatgcctgtaccacactgttttgattacagtagctttgtagtaagtttagaaattgggaaacatgagtcctccaactttgttcttcttttcaagattattttggctatttggggtcccttgcaattctgatgagtttgaggatcaccttttccatttctgcagaaaagccttttgatagggattgcattgaatctgtagataactttgggtagtattgacatcttaacaatattaagtctttctatgcataaacatgggatatctttccatttatttgtgttttctttaatttctttcagcagcattctgtagttttcagagtacacgtttttcacctccttggttaaatttattccttggtattttattcttttagctgctattgtaaatgcagttactttcttagtttcctttcagattgttcatttctggtgtataacaacagctgatatttcaacgttgatgttgtactctgaaactttgttgaatttacttattagatctagtagctttctttgagatttttatatgggattatgtcatctgtatatagagatagttttacttcttcctttccattatggatgccttttatttcttttccatgtctaatttctctggctagaactttcaatatgatgttgaaaagcagtggtgaaagtgggtatctttgtcttgcttcctatcttaggtggaaagctttcagtctttcaccattaagtatggtgttagctgtgggttttcataaatgccctttatcatgttgaggaaatacccttttattcctagttttctgagtttttatcatgaaagggtgttggattttgtcaaatgccttttctgtgtcaattgaaatgatcatgtatttttcctcccttatcttaatgtaatgtgttatattgattaattttcttatgttgaaccacccttgcctttctggggtaaatttcagtcacttatgttatatagtcctttaaattgtgttatcttataacagaatcactctgctactgttttgagcataggccatagggaaaagcaggtaaaaggtaatatggcttgaaccaacattgtagcagcggaagtggtgagaggaggtcgaattttggctttgttttgaagatagaaccaacagtatttgctgacagattagatgcagaatgtgaaaggaggagatgagtcaggatgaatccaaggcttttggcatgagcaaccagaaagatgaaggtgacttactaagatgggaaatatacaaaaggagcagtttggggaaactttatatctattgagtggaatatgccaattagagattcaaatatccagtaaataattggctatcaaagtttgaagttaagaggaatggtctaggctgtttatataactttggaagtcattagtgtataacagctaatttaaaagccagcagactctaagggagtgagtgtagagggagaagagtagaggtctgtgacttgaatcctggaatgctgtgatgtttagagattggggaggtaagaaggagcagcagagtatactgaaaagggattgttatactgaaaagggattgatatagatggagactcaagaattatcacagaaacctgataaaatgtttcaagaagatgggtgtgattaattgtgtcacttactgccggtacattgactcagatgagcgttgagaattggctataggatttgacaacataaaagtcattggaaaccttgacatgagcccttttcgtggagtggagtggttacagtgggtttaagagaggattaaaggagtggaaacagagatgctattatagatgactcgtttgagtagttttcctacaaaggggagaataataatggagcagttagccaaaagttgagtttttttttcttcttcttttttttagttggaaaaaattgcgtatatgttgatgggtcttttctggcagaccagtagagaggaaaaagttgatgatgtaggagatgggaaaatgtctttgagtagatgtcttcgagaaaatgtctttgagtagatgagaggtttgcacacatggagaggttggatgtaggagtactgatagttcatccatagttacataagaaaaggtagatgtattagagttctcctgagaaacagaaccaatgggagatctttatatctctgtgtccatctctatctgtatttctgtctctgtatctatgaagagattataaaagttttaagatctgccaggagacatacccacgggagctaatggtatagttccaggccagttgtgaaggcctgagaaccaggagagcctatggtgtaagttccagtctgagtccaagtctgaaggcaggagaagaccaatgtcccagctcaaagacaggcagagggagcagatcttcccttacttagcctttttatttattcaggccttcaacaaattgaaggcccacccacattagggagggcaatctgctttactcagtctactgaatcaaatgttagtctcacccagaaacatcctcacagacacacccagaataatggttagccaaatatctgggcaccccatggcccactcaaattgacacataaaattaaccaccacagtagagtatatgggtacaaatataattatgtgatatagatttcagggtaagagcctgtggaaattcatttttgattgcttctagtgaaatcggaagcaagatcatcagctaagagtgacgatcggtggaggagatatgaagtttaagtggagaggagaaggtataaaatagtcttaggaggggaggatagtaaatagattagggaaaagttgtaggattgccaggaagtagtaagggcccacttgaggctggtggtcacaaatttaaggtgagaccagtcaaaatggttgtgcttttcacctgctgcattcattcagctgcataggtacaggcacagagtaggtcaagagttcttttttattcggggttagagttttgccaggagatagtaataaagccagaagggcaatgaatttgagggagtatgcaaggaagtggctgttaacttggagtttaaactagtcaagaagagaattaaggactgcccaaggggtgaggacaatgatatggtagcagggcccttaaaagccccagttagatgaaaagattgttggaattgagtttctagagggaatgaacttgaaaaacaggaggtgttggttggagagtgggatatatggaattgagattatggaaggattcagtcgttggtaataacatagtatctttgtaggaataaataggtggagcaggatgcagacaagatcactggaggagggctggtcagaagactgggaggcactatctcccttggatattatacatcaaagcttgtgatctactagacaagtagtggggaaagggtaggatatagatattaatggctatagttttgatggtgatggtcatggtgatgatgatggtccattaacactcaactcaaataccatcaatttgatttatatctaacaccacaaagttaggtgttgagttacatgtggttatattgtaactaatagtcagcccttcatggacttctattctttgatgagactcttcttgtaggagtagtaggtgccttaaagcaccttttcatagttgtcagattgaaatccttcaccagtgttttaggttaaccctgttactgtggaagtttctcttggctttctgtgtgggctgcttctttgtctagttttaccttttggggttagcatactattgtgaataatttattggtgagaaggtaagcagagaagtagagtactctatgacctagtaatttcatatctaggaatctatcctatagaaatgataggaatgccttacaatacccacatatccacaagggtattcattgaacgttatttttggtgaaattcgcaagcaacctaattatcatcaatagggaattgttaaattatgatagataaaatggaattctattcagtcttcaaaaagtcagatcaagaagtggtcttacattttaattatcccatcctgtcaacaagagtgtcttcagttgcaagtaatggaaaaaccattcaaactgacttcagcaataaaaggttatttattggtctgtttcatggagacatctgaggtagagtggccttcaggcaagttcactcagggatccgactatttttctggccttattcttggccctcttctatgaaaacaccttcagggtggtttcttgtatgcttgtaagatggctacttgcatcaaccatgaccacatctagcaggagcaaaagcatcctttcccgtaccagaggagagtcccgaaatttgttgcaattggactgccttggaagcaataattatggccaggagatggaggctagagaactgagacctgatcatagctcctatccttgaatcagttgtatagcaaggggaattggattttccttaagacagttggatttcacctgtagtcttggtgatgaggtcagttccatccataaaactttgctgttacacattttgggatggggtgaggagggctgaatggagattaggatgctattgaaatttgctgtacacaatggatcattatcgtcttctttcttagtgttaaggtaatcagcctctttttcctcctcctatgcttgactttactaaaaccatgagacatgtttaacctcaggactccaatttgaaaaaatatagactgttatttactttattacttacagaagcccttcatactactctcagcaagaaagaggtaggcagggagtgagggaggggggatcatgcttactgagaaacaaactatcgagtattgaaactcccccttcatatgcctgacctcagtcccattcagttaccagtaggggcccctattaattggtacctcaccagcttttgctgttcgttcataaaactgagtcattgaagtacagtagaaaaataattggactacaagataacttatttccttccataattgcaaaatatctgatttttcttcttgtttgtattatgtaaacttaccctgtctgagggtcctcctggattgttctttgcatttatatatacatagaatttcattttcttttttcttgttttttttttagacggagtctcactctgtcgcccaggctggagtgcagtggcacaatctcggctcactgcaagctccgcctcccaggttcacgccattctcctgcctcagcctccccagcagctgggactacaggtgcacgccgccacacccggctaattttttgtgtttttagtagagacggggtttcaccatgatagccaggatggtctcaatctcctgaccttgttatctgcccgccttggcttcccaaagtgctaggattacaggcgtgagccgcttgcccgaccttcttttttttttttttttttttttttgagacgttgagatagagtctcactctgttgcccaggctggagtgcaatggcacgttttcagctcactgcaacctccacctcccaggttcaagcgattctcctgcctcagcctcctgagtagctgggattacaggcgcccgccaccatgctctgctaatttttgtatttttattagagatggggttttaccatggtggtcaggctggtctcgaactcctgactacgtgatccgcctgcctcggcctcccaaagttctgggattataggcgtgagccactgtgcccggccaatttcattttctattttgaaatttaaactaccactgacacttcgttttccctctgttttacttagcatttatcttagagaataatcttaatatgtatagttctattttattcttttactggcagcttagtatgccatattttggatgtgtcattgtttatttacctattaatttaccctataactgcttcccatatttttgcttttacaaagggatgtaatgaacatcctttacatacgtctttgtgcatatgtgcaaatatttccataggatagatgtaattactgacttgaaggttatgcagatttaaaattttgatgccttctatgaaacatctttcaaaatggtgatgccagtttcttctctcgtaattactgcatatggtcaatcttttaaatttttgctggtaatgatatttcaaaattataaccagttttttggcctcatttcttgaataacttgttttttctcaaagataagaaatgtctccttcatcgtatgtcaaatttccatatttacatggatctatttctggacatggcaagttttatttatttattgtatgtatttacggtgtacaacatgatgttttgatacacatatacgtagtgaaatgattcctacagtcaaacaaattaacatgttcaccaccttccatagtctctgcagtcttcaaggttttctctatatgggattagacatgctatgtctgatctgtttttgtatttttacaccaattccacactaattttttttttttttttgactgggagtctcgttcttattgcccaggctggagtgcaatggcatgatctctgctcactgcaacctccgcctcccaggttcaagcaattctcctgcctcagcctccctagtagatgggattacagcactcgctgccacacctggctaatttttgtatttttagtagagatggggtttcaccatgttggccaggctggtctcgaactcctgacctcaggtgatctgcccgcctcggcctccgaaagtgctgggattacaggtgtgagccacctcacctggcacacactattttaattactgtagttttaaaagtttcatatttagtagggtgagtttttccttgttggtcttgtttttcaaaaaaaatttgctgctcttgagtattttctcttcccagtgaactttaatgtaaactcacgtggttcaatgaaaaattctgatgactttttttcttggtattgcttcttgagtgtattgatttaattaatatatttacagttttgggtctggctgtgccgaaacgcagtgtgtcttatccagtccttttttaactgtcttaataaaatttgctggttatctttaaaatggatcttgtatattttatgttaggtttattcccaggcaggttgtcatttttgctgttactgattttggatataaattttggatataattgtataatttggacttggatataattgtatttgattctgtcttatatataaaaatgagataggataataatttatcctaggataaaaataatttgagtatccttattttgcatctggtaccttacttgctcctgttaaacaaatagataaaattacttgtcttcaaagagatcctgtggaaaaattatttattttaggagactttggagctttgataaaaattaggcttatcttttgtaaaagctggttagtgatagcaatcagactcttttaaaggtgatttttttttctttcctttgataaaatgcttaatatgagggaggattaagaaagaggatggcttttgaacagtttcttcatggggaaataagaaattagaataatttcatgttctccaaaaaaaggagaaaaatgaccttccctcctgagcctacttcaagcctctgtttctttctgactctattgttctcatctctgcatttttccaatctcttctactgttagtgttttaggctagctcctcagtggagggcagaaattcaccttctctttagctgtctttgaaaccaagaagatagaggtatgagatcttcgtagtctgtagtaagaataatagaagccatcagaaaaaaatatcaaagctttgtagctgctcctggaagttttgatgtgaagcaggagacatcacctattggtacctgacttgcttttgctgttcattcataaaacagagtctctgaaatacagtagaaaaataattagactggaggataacttttttccttccaggaattacacaatcacaaaattgctgatttttcttcttattcatgttacataaacttatcctgtccgaaaagactgtatttgaacttactatgtaagatttgctttaggtaaatttatggctgcttccagaattgtgtattaattttccagtttcttttttaccagtctccacttttacctttccctcttccccctatacttaaattggtcttactgtaaaatttatgcgtttctctttctacctggcaatgctgattttttttttttttttttttttgaggcaaggtctcactctttcacccaggctatagtgcagtggcaagatcgtggctcactgcaacctcgaatccctgggctcaagcgatcctcccacctcagtctcccaagtagctgggactacagatgtgtgccatcgcacctggctcatttttgtattttttgtagagatagtattcgccatgttgcctaggctggactcaagccagcctcctgccttagcctcccaaagtgctgggattgctggcacgtaccgctacgtccagccagggctgagtttctgaatcatcattgcagcaagagaaattggattacctttagaccactggctctactgtgggctgggagtgggacaccttccttaaagcgcattggacattggctttgtgggtaactgatctttacctgaatgaaatttatcagtactgtattaagggtctagggtggaacggatgctagcaaggcaaccgttaacatccacttactgatgaatcctataaaattttatttcaggccatacgaagtaacagtaataaatataaaaggaaaaatagacaacctaagcaactttttaaattgacttacttgaaaactttccctgcaatttcccggtttataatggttgatttcagctgactggctatagctacttagagaacagaggaaattcattaaaaataatgaattattcagttgggtagtgaaatccagttataaagcacttcgctgtgccatggattcagttcaggtcaagtgatgttcctggtttatgggcagtgtggcttctcactatgacacagcaaagaacgtagcttttatcctttacccttgttactaactaaaattaatggcattttattgtgtttatttgtttgattccatttacagtttatttcacttggttttattagtacaaaattgtgctttatataatatttgacagttaggaaaaattgttagatacctataaagaaacaagtctctcaaaaatcatcctactacttttaaaaattacatcgtcttactacagttaacctagatgtgaatgggtagttttatttagcttttctggtttgtttgcttggtctgtttggagggaagttaagattagcagaaatgtagtaatagattcatgaaagtcttgaaagcttctttaattagagaatttaatgagggctttggcatgcattctttggtttttctctgttttcctctaccccttcttattctttttggttcattgaaaagtagaaagaaattctcaaaaaccgtacaggagaataccttataaatgatatcttctgcaataaactatagattgtatatatgtatatgtatctagatacacaatctgtgtgtgtgtatatatatgcatgtgtgtgtataaatgtataaattagttactagtatatacgtaagtataaaaactcaatgtgcaaggttacattttcagaaaatatgtaatataataaaagaaatcaagcccagaatttttaaaaagtttattgcgctttctgttaaaaatgaaaggctttttgactggaagctgcttctcagtaaaaataacataattgtgttggtgaagcccaaagattctaatgaaaattagggtattgacaaccaaacggaattgctggagtacttaagctgctttggttttgtaatctttctgtgtcagaatatttgaaaaacacttattaatccagtcttgtaacttatccttgaaatctcttttttaatattcttttccacacacatgaaaagttagatgagtgtatgaatttctgttgtcagactagttgtaaacctcctaaatatagtttctgcagtatagttaaagagaaagaacatcctggctaacacggtgaaaccctgtctctactaaaaaaaaaatacagaaaatgagccgggcatggtggtgggtgcctgtagtcccagctactccggaggctgaggcaggagaatggcgtgaactcaggaggcagagcttgcagtgagccgagatcacgccattgcactccagcctgggcgacagtgcgagactctgtctcaaaaaaaaaaaaaaaaaaaaaaaaaaagaaagaaaataggcccagcaaggtagctcacgcctgtaatctcagcacattgggaggctgaggtagggaggattgcttgaggccaggagttcaagaccagcctgggcaacatggtgaaactccatttctacaaaaaatacaaaaattagctgggcatggtggcatgtgcctgtagtcccagctacttgggaggctgagtgggaggattgcttaagcctggggaggttgaggctgcagtgagctgtgactgagcaacagagctagactctgtctcaaaaaaaaaaaaaaaagagatgggttttgaaattcagtactttttttgagtgaggtccaatgggtcagaaagaagcattggataaatgaatccattttctcttctctgtttgaatttgtaatttgaaagaatattctacctataaagtacttcagtgcttaattagctgtcagtgaatttatatatcttatctaattcatatggatttgctatttttatctgtacctacagattcctgacctctctaaggggatcccagtatactatagggaatgaggtataatagaagtaaaagacctatcactagtcctgtcatcattccaactcatgtgtaattatagtttaaaagaagtgacatcatgtgtattgctgtttatctttacattaatcttgtggtcaagaaagcaaatactataatatataataattatataatatcataagacaagtaatataataatgggaatataatcccattttacaaatgaggaaatgaaaatttagagaaataaagtgacttgtccagggtcacatggatactaagtgaccaagtgtcaaagcagaattttccaaataacttaaagataattcttgtacaaatatagaacgaacacatgtcatatgtgttgtgttaatgagggaaccagaaggatgacaacattggttcagagagatgcaaagataaatatagacattggaggaaaaagttggaaataagattgttaggttagatacaaagctgtgttataggccaataaaaaccatagactttgaggttatcttttttactggacaggattcagttacacctttatgagaccaaaatttattatttaacatgtggatattagagtctgagttttaaaattattagtaaatgaccgtcaaataaagatatgtcccctaatgaaatactgataatcgctgggtgagcttgtgctcctatatgacattgaaatgacatactgccctctctttgtcttctaagttttggatacttttttttttttttttttgacacaaagctgcattagaacctaggtttcttgactttcagtccagatttctttccactctacttcctgcttcttcatagtataattttcaacactagagcagtctgcataacttttgcaaaatcagctagtctttcttattagttttcctttgtgcaaagtgatgtagatacagctttcttcttcagagaaacattgtgaaattcaatgaatatttgtaaaatttgcatacgtgcccaatgtgagaaattgaaattattacttaagtattgcaactgttcttttaggatattttgtttgcaaatttcagagtaattataaatattcttgcatttttattgtaatcagtatttataaaacagtgtatttcatcacattaacctttacatattttgaataaaatagtattgaaccattttaaatagtaagtggaaatttttccacattaaacagtataacgggctaacagagttaagcattgcattatttaactaataattttttcctgaacttcagattattatctgtatgtgtcatataacttgacaattttttttttttagtgctttttaaaaagagtgggatactttattcagtttagccctcaagcaattaggcaagtcagttaccatggtaacagtaggtattaatttccttacctagttagaggttttatgaacaaagaaatctctgagttcatccaccaaaacccaactttctcttgagactggcctcttgagactggtgttaaatttgtctattttctagaagatgacactattctaagtggaaaatacggttctcttgaggtgaatttctactctatcaagagtgaagtagagtatggcttaaaagttaagtgattaaaaagctaccctttcttagctaatttggaatgtaattggtcttaatttttctaaattcgttctaaccaaaatcttattggcgtgatttctattgacatgaactagaagtgacttcagcagacaacttgtcccaatatctaaatgctgtcaaatagaatcacttaagatgaatttcttccaaaacagagttcacaattttgacagataatctcttagcatttaattgactagtattaccaaccttatggaataggtccactcgtttagctatcatgaggaccattttgcaactaacttatcaaaaagccttcaccaagaagttgcatatcttattgatattttagaatgcgattatggagattaaaaatcaccacaatgggttgttaataacgccagccttgaactttcagttttagagcattttatctgtgttctgtagtcaaagttggtaaggtgtccagtgggtcatgtttgacttgctgcttgtttttgtactgtgtgctaaatggtttctacatttttcagtggttgaaaagtcaaaagaagaataatattttatgaaatttaaataaatccaggtttcagtgtctataggtaaaatttcattgtaacgttgttatgcttaagtattgtttatgacttctttgctatagtgacaaacttgagtagttttgacaaagatcatctggcctgtaaggcctagaatagttactgtctaaccctttagagaaaaaaattgctggcccttgttctatagtatgaaaaaatatagccttgattattcattaaaaaattattttcccattttattgacatacttttgtcccctgattgttaaaaggaatgcatgttcttatagaaaagttggaatatatagaaaagtataaagaacaatatgaaaaaccatttgcaattgtgagataaccactaatgttttggtatacattgctccagacttacacacaaacacacacgcgtatttattttatacaattagagtctaattttttttttgagacagtcttgctctgttgcccagggtggagtgcagtggcaagatttcagctcactgcaacctctgcctcctgggctcaagtgattcttgtgcctcagcctcttgagtaactgggattacaggcgtgcaccaccatgtccagctaatttttgtatttttagtagagacggggtttcgccatatgcccaggctggtctcgaacccctggcctcaaatcatcggcctgccttggcctcccaaagtactgggattacacacgtgagccactgcgccttaattttttaatttgcttttttcacttgaataattataagaacattatttttaatgactgtgtagtgttctgttttatggatgtaccatacttaattatttagtcataatttattattatgaggttgataaacatgataatcagattgagctcaagaagctagttatagggttgcacaattaatgaatcccaggtacctcgctgggttgctgaggctgctatttttttcctgcctgtttggaacactgtgtttgggaccaatgaggcaaaagaaattgaagagctgccattttcaattattctattagaagatacattgaagatttgtcaaatgacatagacacaacactaatccagaagattatttaatcaaaaaggcattcatttcagatatgaattcataaacatttgtaacgatcctcagtttgaagaccatatagaatccctgaagaactggaagacactatttgcttggcaaagagaagtccccagaccaactggggatgaaatattcaaagagataaatgaatactttgaaacatacaaggtactatggaaaaagagtggaagtttgggacaggtaatgacaggaagatataaaagctttacattaagttcaatctaaaactttattccaagtaacaggttgtcttattcatggagaagcagttgtaaattaaaacttgcctgtggtttggaatttcacattaaatgattacattaaaaattcaaatggtgaacctaactaaatccaagctcctacagtaccttcttttcacctttaggtgaagaaatgcggtgagctattttattactgattatgtggacagtccaaaggaaggttcataagcgaaaaggaaaaatttaaattattccatgtgagcgattcttactttgcagatttgttgaagtgtagttactggcttcaaaaagtggtatccttaactgacattttgaacacttgaattcactcaataaaaaaatgcagtgatcatgtggaaaatacattaaggtatatgacagagtttatggattcagagcaaaaattcagctttggaaaagtgaagttaaaatggttttttaagtgatgtttaattggtgttatttgaatcctaaagaagaattaatagtactagtagaggaaagtcagtgtgtctgtgacaaagctttagtattattttgaaatacttgatataaaaaagttcacgtttactcaaagcttacttaaatcatcagaataaattaacatgtttcttaattaaagaaaaggagaagctattagacttaaaaaatttttgcacccttgaaatacatacaatttgaagagattaagttgttggaatactggttaatggtgaaaaaggagttttcagtctatgaaagcaaagccttctcctttgccatttgcttttttgtagtggttgctatgtagaattcgaagaaaatattgttaaaaagtcttggtcaggagtagagtgtagcatgaacccaatgcattttaacgttaataatgaggaaaaagggaatgcatgataatttcatcaagtcagaaaaaaatggaaaaagaaaaagaggaaactgaagaaagtaactgatgaaagtaaggtgaaagggaaaacaactttttataccacctgtgaatgagattaattttcgtttccatactgaaagacaaatatattccaattaagccattcaaaataaaaaacaatttttttttggtaagagatgggatctcactatgttgaccaagttagtcttgaactcctgccctcaatcagtcctcctgcttcagcctcccaaagtgctaggatttcaggcatgagccactgtgcctggccaaaaccaaaattaagcaacaaaacaacaacaacaaaaattccagacagcctttaaaataatgataaaggttgaaaaattgtagatagtggtaggtagataagatttcaggaaaagtccaaagcaaatcataatacgttattttaaaggggggtttaaaatcctttaaaggtacaatgtgaagcattatgaaatgataaaatacatgttttttaaaaacattaattttattttaagttccaggatacatgtgcaggacgtgcaggtttgctacataggtaaatgtgtgccatggtggtttgctgcacctatcaatctgtcacctacatattaagccccgcatacattagctgtttttcctgatgctgtccctcctccaggacccagtgtgtgttgttccccatgtattctcatcgttcggctcccacttataagtgagaacatgtggtatttggttttctgttcctttgttagtttgctgaggataatggattccagttccatccatgtccctgcaaagtacatgatcgtgttcctttttatggctgcatagtattccattttatatgtaccacattttctttatctagtctatcattgatgggcatttggtttttttccatgtctttgctattgtgaatagtgctgcagtgaacatgaacatgtgtgtgcttgtatctttataataaaatgatttatattcctttgggtatatacccagtaatataattgtataacccagtaataggattgcagtgtcaaatggtatttctggttctaggtctttgaggaatcgccacactgtcttccacaatggttgaactagtttacattcccaccaacagtgtaaaagcattcctatttctccatagccttgccagcacctgttgtttcttgattttttaataaacgccattctgactggcatgagagggtatatcattgtggttttgatttgtatacaaaaaagatttgtatttctctactgatcagtgatgttgagctttttttcatgtttgatggttgcataaatgtctttttttgagaagtgtctgttcatgtcctctgcctactttttaatgggattgtttgttttttttttcttgtaaatttgtttgagttccttgtagattctggatatagacctttgtcagctggatagattgcaaaaattttctcccattctgtaggttgtctgttcactctgatttgctgtgcagaagctaaaagacatgattttagaaaaagacatgtcaaagtcatacatgctcaacgacatagcgagtacatatgtaaataaaaaattattttatgctgtgaatttgaccgaaaataacctttacctcgtcaggaattacaatcctcacgtatggtaaaggatttccctattgcaaattattccacaacattaatgttctgtgtgctttttatctatcccaagatacaagtaaatttgacaaagatattaggtttgtaaacaaatttacgttcaaatctttgcctggaagtatctagatagaattttgcatgcaaaagagtatttacatctaaaaaattacatatttcaaattaaaatgattttagtgttatagatagaaggaaagagttattgaagtttatttctgttttggcagtgtaaatgaattacttacaaaattttagaagtctacaggtgtttttataaagtttgtgttatttgtggaaacctcagttttctggcattttgccaatgaggtctactctaagtatagcagaaatttgttttccagctttataaatatatattttaagattaagaactgattttacttatataatctgggatcaacttttggcttctcctgtcaaggattttgaatttgtgacaaaatatacacttattgataaccagtgacatatataaaatgctttacaattaataaagcatatgtattttacatattttttcactacatatgacgcatgtggcaaccccaagagttgagttgtacccatcggcaaactttgatcatgattctgtgaatataggcaagcaccaattgcaggtagaacattctttttttgagtcccaaaccgtgagaaacaaattacagaaatgtacctttcttttgcattaggacacgttgtagttttgtatgaacactctagttttaagcagtatgtgcaaaaacattgcacaaaggatttgtgtgttgattttgggactcctgtattattaattatgtggtttatttgactaccccacattttcaagcataaattaataaatccataattccaggcttattaacaataaacaatctagatagttgaactctttcttgctaacattttctagatatggactgtttggtatttttctactaataaagacccttagtaagctgccttctggtttgatgtcattgggatgtttactgggaactttggtggagatcttgcagtctctctcccccagtggtgaaagaatgagttacaaaccagctttccttcccagtgtacaatagcgatggagtttgttctatatggaaaatttgtttgataaaagtattctttaaaattttttgttccataaattatcagtattttcagtttctgattcatgcttgggatagttgctgcatattgtttaattttgtcagaatttatattgttaaatatcaaatacgacagactaccctcaaatcataagtagttaatgtaattaacatcctgtttcatcatgagactcttcagtgttacattaaaaactgctacctcctgggccgggcgtggtggctcatgcctgtaatcccagcactttgggaggctgaggtgggcgatcggatcacgaggtcaggagattgagaccatcctggctaacatggtgaaaccccgtcgctactaaaacatgcaaaaaattagccgggcttggtggcgggcgcctgtagtcccagctactcaggaggctgaggcaggagaatggcatgaacccaggaggcagatcttgcagagagctgagatcgtgccactgcactccagcctgggcgacacagcaagactccgtctcaaaacaaaaaacaaaaaacaaaaaaactgctacctccttattacaaataggaactaaagttgaagtttgaggaatttgctaagaactaagccttgaactaaggctattttatttgagtatgagtcatatcagggtacggatccattttactattaacaaaacaaatatgttctgttttttttttttaaatgcacacaccacgtttgagagattcttattcactgtattttctttaattatacttgaattttggtttacattgaggagtgccctcaaagatattaacagatttttaaaaaatcctctaaaaaactcattcttagggaaatttgttcacttactaggtgaggagcaaaataaaaatccttaatatagaagagctattatctgtcttcaaaattaagtctttgagtagatttgtgaataaatctaatagttttgctgaatttacttagatcttaagacagaataatcatgtagaaaatttaaaatgtcaggaattcataatgattcatatacccaaggattttcattgatagtgaggtaaggttattcttgagaaagactcaaagtcataaaataatagaatttcgaaactaccagaattatacaagtcaattaaaatgactgatttgttttaagaggaagaaatactaaatgtataattattagatgcagcatattgtatctgttttgttttgtgattctagctcttataacctatgcttggacctaggtgtcataacttactttaaatatgtatgtttggttttcattcatattgacagtactacctctcagttttctttcagatattgttttgtatttacccatgaagacattgttttttggactctgcaaataggacatttcaaagatgagtgaaaaaaaattggaaacaactgcacagcagcggaaatgtcctgaatggatgaatgtgcagaataaaagatgtgctgtagaagaaagaaaggtatgttgttcattgactattctttcgggtgagaaatttaatttatatttgactgtgcaaagagtcagttgttacttgtaaacttcaagtcattgtttaggtcagagttgctgttgtctaaatgcaccaggacctagttgttgaaagggtaaactggaataaactttaattgggtttacaaaatgagaattcttactgtatattttctctttttcgggttgactttaccagtttgttctagttcagataatttagacaacattaactttgttgaattttttgtttgccagccggtcttcagcattttaaggcaacattattattacagttgtaatacgaatataattaccagagaaaaaactcaggaaaataaatgcttttatgaaaatgggattagaggtttgaaaataaacttgttaggagaaataatttcacaatgggatggttttttctttgttaagttttctttatgacttcattagtttataaaacattaattgataaaacttagaactataaattgaatgcttcagtgaactttattatttcagtgaacatttgttatttgatgtgaactttgtgcctgttttgaaatttactaaactcaaggcatgtgttcggaagagtgtttttgaagatgacctccccttcttagaattcactggatccattgtgtatagttacgatgctagtgattgctctttcctgtcagaagatattaggtaagtgatttgaatttcctgattttatttgaatttggacccttagaaggtactattatggtaatgtttgtgaatatactgagttttacaggtgaggtgtgttcaatagataattatttctatgtatacactatcaccaagttttacatttcaaataaaagtcactgaattaatttgtaatctgtcagtttgttcattcataagcttttctattacttcagacagtttttttttaacttttttaatatatgtgctgctgaagcgagcacgacagttttttaactttcagtacttaagatgttatatatagagctactgaacatactgtgtttattttaccaatttagggaaaaagtgcaaaaattatttaacctttaaatgcacctttatatttcattaaaaatatcaacatagtaatattgaataatggctatgatcggctctgttgtgtgtaattagtaacagttgtagcaaatgatccttaaaaaatgttctaactaaacattagaggccaggcgcggtggctcaggcctgtaatcccagcactttgtgaggccgaggcaggtggatcacaaggtcaggagattgagaccatcccggctaacatggtgaaacaccgtctctactaaaaatacaaaaaattagccaggtgtggtggcgtgcgcctgtagtctcagctactcaggaggctgaagcaggagaatcgcttgaacctgggaggcagaggttgcggtgagccaagattgcatcactgcactccagcctgggcgacagagtgaggctccgtctcaaaaaaaaaaaatccaaaaaaacaaccccacaaacaaacaaaaaacattagaaatgtctgttagtacttttaaaggttgccttgtaaaattaggactgcaatagtgcaatctaaggctctcaaagcataaaacaagtaataaggaattcattcagatattttccgaggtggttatacctgtcttttaaaaaaaaaattttgttatatattgggttaaaaaaagcagaggtgctgggcacagtggctcatgcctataacccctacactttgggaggccaaggcaggaggattgcttgagcccaggagtttgagaccagccatagtaagacccccatctctacaaaaaaatttaaaaattagccaggtgtctgtggtcccagctactcaggaggcctaggttttgggcccgagaggttgaggctgcagtgagccttgatcacaccattgcactccagcctgggcaacagggcaaaaccctgtctcaaacagacaaacaaacaaacaaaaggcagaggtaggttaagctatttattaatggtcttctactggtatagatataagctagaaataacattcaagtgtttttacttttactacagttatctggccactttgggactcattatactgaattagtttcacagaggaggtaaaatctgttgtttatgattacatattaactctaccattttaccttcagcattgctgtagtatgtcatatctgaaggcaattagcacaagtgacttgaagaattgtagttttgatgacttatatgtattttataaaaggcaggcagagtttttgtgtttgctttcccctcctctggacactttaaatttttgctaccacaggtttccaacaatttgattatgatgtgcccttgtgtaatgtggttggtgtttatttggcttggagttcgttgaatttttttgatctgtgtgggcttatacctttaatcaaatttgaaaaatgtcttcagatcctttttcctcccatcctgttattcttttctctttctgggactcttagtacacacaagtttgattgcttgatactgtgtcacaggccactgaggctctttcctttcagtcttttcttctttcttcctttttttctttctgtgcttcattttgaatagcttgaatagttttgtttcctgtcttcaagttcacttatatttttttcttctgtagtgtctggtctgtttataccatcctgtgaatttcttttttagatactacatattttgtttatctctagaagtcccatttggttcttaatttttttttccattttggctctcattattcatgtttctttcaaaattcttgaacatatttagcatatttttaatagctgttttaatgtacttgtctgttaattccattattctagggtttttttctttctattggatgatttttctcctgattatgggttatattttcctgtttattcctacagctgttaattttttttttttttaattaggcattgtgatcttactttgtggaatgttagattttattgttttcctttaaagaaaggaactttgtcagacatctaagttacctgaagatcaactttatgttttgaagcttgttttcaagcttgatcagggaaagtctacgtttgcctttagtctaaaggtaatttagccctataataagatgtgacccttctggagtctttgtagactgcctctggtgatcaacgatctcttctctgacttttcagaacgttaatgcctcttacctttgtgtaagtccgtcctaagaatcattcagcttatggttgtttgcccagccccatagagttttagtctatgcatgcttgtcttcgtattctgcaaagaccaaaggagtcccttagggagatttctggagctcttttcctgcctagcttcctcctctccagaactctgccccgtgagttccaggtccttcagcttccagggctctgaactctgtctccccaactcagtgctctccttgggattcttctccctgttctgttgtctgcaatgggtcccaggaagaatgtggggcaactgtaaggttcacccttcatttcccttcccttagagatcatagtcctgtactgcctgttgtctagtatctgaaacagttgttttatatgttttgtccaagtttagatttgtttgtggtgggagggtgagtctggcctcccttgttatatcatgttggcctgaagcagaagctgagtttcttttattttttaaatatagtttcaatttttaacaactattaaataggcaagtatcaacaacaatagataacaatataatagatatgcatattcctcccactttatcaaatcttaattttcttcaatttttttttttttttttaatagggtctcactctgttgctcgtgctggagtgacagtggtgtgatcttggttcgctgcaacctccgcctcttgggctcaagtgatcctcctgcctcagcctcctgagtagctgggactacaggcatgcaccatcatgcccagataatttatatatatatttttttatagagatggggtttttgccatgttgcccaggcggtctcaaattcctggactcaagcaatctgcctgccttggccccccaaagtgctgggattacaggcgtgaaccactgcgcctggcctgttttcttcagttctttattaagaaatgaaacagtaaaatacagctgaagccccgtgtttgttctttctgattctccctctgtgcccctctgagataacttctatgagttttgtgcatttttttttctttttaataaaaacagggtcttgctctgttatccaggctggagtgcggtggcgagatcatactcaatgcagcctcaaccttatgggctcgagtgatcctttcgcctcagcctctcaagtagctacaactactggtgtgtgctgccatgcctggctaattttttatttatagtttttaaagacagggtctcactatgttgcccaggctagttttgaactcctggcttctagtgatcctcctgccttggtctcttacttaaagcactgggattacaggtgtgagccactggctgctcacatgttttttataatagtacttaataattttatgtctgaaaatattatataatgttattttgcccatttaaaaactttaaaaaatgctaacaaactgtgtactctgtaacttgtcttttttactcaacactatgtttttgagaatttttcttgttgatctgtgtagttccattttaactgttatatcttactatgtttcattatgcaacagttggttcaatccattctcttgttaatggaaatttagtttgtttctaatttttgccagtaggaacagtgttgcaatgcatattcttaaacatgtctgtacacatctgagggtttcatttatttgtgacaaaacttgccaggtcatagtgtttatgcaccttcaactagatattgtcgttgtcaaagtttttttccaaaaggattttaccaatttatacatgaaccaccgatagatatcctcttaacacgtggtattctgaaacttaatttttaccaatcagatagatgtgaaatcacgtagacttagtttgcatttctttgacttctagtgagaagtagtgtcttcacatattttttggatttttaaaatttattttttatttttgtttttcttagagacagggtcttgaacttttacccaggctgaagtgcagtgatgcgatcatagctcacgctaacctcgaactcctggactcaagtgatcctcctgcctcagcttcctgagtagctgggactacaggtgtgtgccaccaagcccagctaatttttaatttttttttttgtagagacatgctgtgttgcacaggttggtcttaaactcctagtctcaagcagtcctcctgccttgactttccaaagtgctgggattacaggggtaaaccaccatacctggccatatcttttggatttattggtcatttggattttcttttgggaattacctgttcatatttttctccatttttctgctgaataatttgtcttttcttacttatttttcaagaaattttacatattttctggctgttcattgtcagttgtatgtgctccagataacttgaacagtctgtggttgccttttaatttttgaattatgtctttagttatgcagaagtttaaaattttaacataaattaatttacactatttttctcactttagcatgagtctatcagatggggatgtggtgggatttgacatggagtggccaccattatacaatagagggaaacttggcaaagttgcactaattcagttgtgtgtttctgagagcaaatgttacttgttccacgtttcttccatgtcaggttggtatctctacatttcatttttatatggctgataattgtaatatgtcaactttatccctataaaattaagttcttttattagctggccgttctctcattatctcaaatttatttaagtatttatgttctacctgattcactcacattccttgttttatttaattttcacaacatacctgtgaggcattgacattttttctgttttagagaagagaaaactgaaattttaagaggctaaatgaccaggatatgtactgctattgctagcaggagtggcattcaaactgattattttttcttgtcatttatcaatcaggactgtttgctttagttaagaaatactcaaggtcaatgtgtttctgaatttaaaattactgttaaatacaaatttatacataaacatggtatgtataagaagtaggacataaatccatcatacttgacagaacttatggaaataacaagaaaatgttacagtttttccccagggattaaaaatgttgcttgaaaataaagcagttaaaaaggcaggtgtaggaattgaaggagatcagtggaaacttctacgtgactttgatatcaaattgaagaattttgtggagttgacagatgttgccaataaaaaggtaaaagcaatatatatataattttcatgatgaagattattttgtgttacacagaatgtactttctatctgaatgttagatttttttttgaaaaagcttgttatataatgtttttgtagcaataaaaaagttccaagtgaatgttctttaatgaaaacctttatttatttatttatttttaacttttgtttcaagatcggggtacatgtgcatgtttgttacacaggtaaacttgtgtcatgggggtttatcatacagattattttatcacccgggtattaagcctggtacccattagttatttttcctgattttcttcctccctcctcccaccctccacctcccacagtgtgtgttgttcccctctgtgtgtccatgttttcttatcatttagctcccacttataagtgagaacatatggtatttggttttctgttcctgcgttagtttgctaaggataatggcctccagtgccatccatgtccctgcaaaggacatgatcttatttattttttttatggctgcatagtattccatggtgtatatgtaccacattttttttaatgcagtctatcattgatgggcatttaggctgattccatgtctttgctattgttaaatagtgctgcagtgaacatatgcgtgcatgtgtctttgtaacagaatgatttatattccttttggtatatacccagtaatgggattgctggggcaaatggtatttctttctttaggtctttgaggaattgctacacagttttccacaatggaaagcctttagttctaatccatgtcttggcatagagtttcttttctttttttttttttttttgaggtggagtttcgctcttgttgcccaggctggagtggaatggtgtgatctcagctcactgcaacctccacctcctgggtttaagtggttctcctgcctcaggctcctgagtagctggggttacaggcatgcaccaccatgcctagctaattttgtatttttagtagagacggggtttctccatcttggtcaggctgatctcgaactcctgacctcagataatctgcctgcctcggcctcccaaagtgctgagattgcaggcgtgagccaccgcacctggccggcagacagtttctttttttctttttgagacagagtcttgctctgtcgcccaggctggagtgcagtggtgcaatcttggctcactgaaacctctgcctcctgggttcaagcgattctcctgcctcagcctcccgagtagctggcactacaggcgtgccaccacacccagctaattttttgtattttttttagtagagacgaggtttcaccgtgttagccaggatggtcttgatctcctgacctcatgatccacctgcctcggtctcccaaagtgctgggattacatacagtttctttaagcaagccttctcttttccttcctcccagttcttggtactctttcactttcatatatttgcaaatgtaaaattgtgttttaggtgtatatttttaatccatgtataccagtaacttaaaaaaaaatttttttttttttaagggagagcataatggagctcttgtgatacggtgctcttagtggaagtttggctatcaattccatcacctgtatttcacatattttattaatgaagttcttaaattaaattctcatatttagccaagtattcatttggctgggaggtagaaagcctactaaccaactttttttcatgaacaatatttttaaagtccaagatttttaatacctacattagggaaattctagaattaaattcttacaatgtggactgcatatgaggcttttagtgacagggaatttgttgaaggctatctgtgggttgtattttggtataacatttcctaattttatttgtggtatgttcatttgatatcatttggtaatacctgaaaacaggaactgattttactgtgttgctttttcatcatttctagctgaaatgcacagagacctggagccttaacagtctggttaaacacctcttaggtaaacagctcctgaaagacaagtctatccgctgtagcaattggagtaaatttcctctcactgaggaccagaaactgtatgcagccactgatgcttatgtacgtgcttaaagatctttagaaattgtgatgtgttttaaaaacattattataaatgactttagaaaaattttattatagtagtggcagaaactctaccaaaatattttatatcaatttggcattgaaaaatgcttaggaagacatttagtgaaactattcattttcgatattaattagcaagtaccaatcaacagattgttcaatgctagtttattttcattgtcatgaagccaaattaatgtctaatttgtatgttaaaaaatgtgaacttgctgaaaacatgaaaggctaataaatccaggctgagcaagcataaatagtactgatgatggatttgatatataaacaattcagaatgaaaataattatagtacagtttctattttaaaactggccttatttcttatatataaaatgtggtgaaattttagaaaaattgcctccaaatttagcttgttgctgccattagatatatttttatatttacatgtttgtatgtagtgaaatctgggcttatctttatatatagcactattgtgtgttttttaagaaatgtattttattccacagtgaatttgttttctcctaactcatgctttcatttgtagatgaatattttattgtttctcctttgcatctatcaaaggaatggaaactcctttgaattgtaaccagcaaacaattcacttttgttagggaaattggatgataattttcctttaaaagataccgccaaacttgagactaacattctcagctgatttaagtaggatttctcttactagattgcattttgttagattccattttaagttattttatttggatattgtgtgtaatattgagtgtgaaaaagtgaaaacaaacttttaaggctcaggcacctttctcaattttcacaattggtatgattattaaatgaggacatattgatatttgtgtcacataataggttgaattccatgtttgggtgctttgtgaatcattctcttcgatttttctgaagatgggacttactgttttatttcggtgatctttagcatactttttaaatttttctgtttttttataggctggttttattatttaccgaaatttagagattttggatgatactgtgcaaaggtttgctataaataaaggtatgttaagatccataaataaaatgtgaattcactcttttgtgaggtttatctccaaaaaaggcaatattcacatatttgcaaagcatttagtactataacttcttgaatgtctgagcagtcctgacattagggtgggatccatcagggcccaagatgagtgtttcatctttgttacttgtggcaaagcagcccttacttcttttactttgtagcattgctatgtatttggcttctagagttggggctttgtggctttcttattgcagtgacacaaccagctttctcctagtctggagattatacatccttgctataagtatttaaaatgctttctatataatgctttaaaacatgtaagatggcttatccccaagatggtagctaataaacactaagtgataaagtaggtaaagatctatttattcatttattaaatattgttggtcattttacagtgctttctaacatactgatttacatttctaattttcttctgtcatttttctccaaaaataatggtcatgtcatccaacctcagtgctgtttttagaggtcttgataagccagtgagagcagaaggagccacgtagtagagtgggtgagcccaggctttttgttgcacagaccaatgtgaatcccagccatgtgacctgggatgtacctgtttctccaaacatggaatgtagatactagcataatgtccgttttaccgttttatagaataattgtgaagacttaaagggacaaactattcgaagcatctgtattgatataaagttatcactattctcgtagcttccttttggagattttaaatgattgtgtttgttaagatgttaattaaattaggccattttgctaaatgctcttaaaaatatggcatgactgcctcatataaaatgatatgatattctttataattgtcgttgagcctctgtgggtggcaggccctcctttatatgttaaggtagaagagtctttattcttacttctcctccctggagagccacttcctatgaatgcctgctggttctctgtagtcagaggtcttgtggctgtaacttagagtcagtctccatatccctgggttctgcatctgtggattcaaccaaccacagattgagaacattcaagccaaaaaaaaaaattcacagttttaaaaaaggaaaagttgaatttcttgcatggagtaccacattgaatctatatgaatgaagtgatgcgtaggcattttataaggtattataagaaatccggagatgatttaaagtatacaggacaatgtgtatagattatatgcaaatattgcagcattttatataagagacttgatcatctatggatttgatatcagtgggagggaggttcctggaaccaatccctcaaggatacagaggaatgactgtatgttaattaactgaggcaggtgatcggttttttaagctgattagggaaacagtatataagaacttacttaactcataataaaactaaaattcaacaggggagagttatgattttttggctttatggttgtggaattgcatgtaggttacatgtacaattttgttacatgtgcaattttgatgaaaatgcttccaaggaatgtttatgatatttttcactaaagtaacatatattaataacacagtactggaagtcctggtatctgtgtacttgtcattgtaatgctacattatttgaccttcactttttttcccctttattacattatatgtgtgagtatattgtgacatcttgactcagattccagtgaattgtattaggttggtgcaaaaataattgtggttttggtaatttttaatggcaaaaaccacaattacttttgcaccaacctaataactaagattaccatctttttttccttccttcctcccttccttcctttctgttattcagccagaagtatcagcatcactgttctcttattttcttcatgtacatatggatgatattttcgaatgaccacttttctcttttgctttttattattagactgtttttttcttcttgttaaaggataaaaagattagaacataaaaggatatttacacattgtttccccattgacttattcccaagatggtagctaataaacaccaaatgatatagtagttaaagatacattgactcatttattaaatattgttgagcattttacgatatgggaataccgtagtgaacaagccaggcatactctgtttcctgaggggcctacagttttattggggatatagatgagtgaagaaagcaattgcagtgtagggagatgagtcttacgtcatgggaaaacaaggtgctgtagttgacacaccgagaggcatctgacacattgggggaaatattctagaatatttcctggagaaagtgcaggtaaaagccagacctgaaacctgagcaagagttagctaaggccaggtgcagtggctcacgcctgtaatcctagcactttgggaggccgaggtgggtggatcacctgaggtcaggagtttgagaccagcctggccaaaatggtgaaacaccatctctactaaaaatacaaaaaattagctgagtgtggtgacgggcacctgtaatcccagcttcttgggaggctgaggcaggagaatcgctttaatctgggaggtggaggttgtagtgagctgagattgcaccattgcactccagcctgcacaagagcgagactctgtctcagaaaaaaaaaaaaaaaaaagttagctagctgaagagtataggaaagaatgggtacaggaaattacaggtgccaagttacagaggtgagagaaattatggtatctataggtaattgaaagtaattcagtatagtgaacattgaatagggctgggcggatgaaggcaaagcagaaaaaggaaagcagatgggccatggtaaggagtttatatctcctcccaagagcaatcgaagtgactgagagttttaaacacagcagtgaagtgaattacattaaaaaaataagaacttgggctctagaataaaaaacggatataggaggaaggcaggagtcacagtaggaatatcttttgggaggctgtgacaataatccaagtgagaagtaatggcaacttgagtcggttaattgtgttgagaatggagagaagttgacaggttcaaaattcatttttcttctttttttgagtctcactctgtcacccaggctggagtgcagtgatgcgatcttggcttaccgcagcttccacctcctgggttcaagtgattatcctgcctcagcctcctgagtaactgggattacaggtgcctgccaccacgcccagctaatttttgtgtgtttagtggagatgtggtttcgccatgttggccaggctggtctcgaactcctggtctcaagtcttccgcccacctcagcctcccaaagtgctagaattataggcatgagctaccacacctgacctcaaaatacatttaatagagcaagcatgagccactatgcccagcctcaaaatacatttaataaaccaatggaatttgaggtaatgatgaaagacacatgtcaaggatcattcctgtgttgttggcataagcaacagggatgaaaagcattgaggaagagcaagattttgggatgcgttgtcacacagttgattttaggtatgttaagggagggagacctgtaagacagcaaagtggaggtggtgcaagaattagttgtgttggctgtagcacagaggacagtttgagttaagagagttgggactgagaatcccgaggaactcttagtgttgaacatttgcgtggaggaggggacaccaaaggagttgccatagacatcgaggaaattaggaggtgtggtgtgcagaaagccaagtgaagaacatgttttaagtaggaggatgctatcaactgttttaaattctgctgagagtttgagaaactgaggacttagaattcatcattagatttggcaatgcgccaatcatttgtaatcttttaaacaatagttttgctgtactgggtagcaaaagagtgatttgaggagtggtcatttggagcatatgctattcaaacagagaagagtccacgggctttggtaacatgaaggtcctataaccatagcaagagaatgaggtgggtggaagtcatattaacgtgaatagaggagtaggttagatctgaggaatgtgggaacagagacagggtctcattatgttgcccagcctggctcagactcgtggcctcaagcgatcctcctgcctcagcctcctgaatacctcgggtttcaggcctctgcatctggcttgaaaacaacattttctcagaagcttgttttagttgttttagaaataacgaaggcatgtgtaaacaactgttctagaagcttagtttggaaagggaacgtttattgatgcatataacacttatatgttgggtgcttatgtgtcaggcactgttagagttgctcgggaaaatttacaaaccaagcaaaccatgccccttcatttcctttgggtgaagtgagggagccatgtggttatctgaaggaagagcttagcaggattagagggaagaaagtgcaaagcctcctagggtgattggctggctcttttggaggaacagtacctataactgaatgaaatgagtgagggtaagagtggcaggaaatgaggctagaaaaggagcttgggccatatcacgtagggcctcgtaggctgtgaatctgacttcatttcttattaatgaaaataaatacgatgatgggtgatgggaaacccatagaggatttggagcagaagaatgatataattaaaattttattttagaaatatttttctggttgtcgtaagaggaaaaatatttagccccagggcattttggcagagagttaggaggctattgtaacagcccaagcaatagacaataattgtttggattaggcgggtagcaatagaggtgatgagaagtcgtagcttctgtaggtatttggaagatatatattgtgaaggatttgctgatgaattccctgtaaggggtgagatgtaaagattcatagaacattaagatattttggtcagatcatctgatcaatggaaaggtcagttatagtggacagattatgagaagaacaggtttgggtgagaaaactttagatttcagtgttggatatcctaagttttagatgattattgatatccaagagatatcaatatttgggatcaatttgggaaatatgatcccaaagttcaaggttgaggttggagatgtaattcagatccgatggtagttaaagcagtgagactgaatgagataaaatagggagtgaatgaaataaagagtaggtgtgatattgacctcaagggcacaccagcatttagaggttgggaagatgaggagagagcagcaaagaggactgggagggccactaatgaaggagggaagtacaggaggtgtttagttctgaagccacctgaagaaaatgtttggaataggaagaagttgtcagttgctttaaatcattcggggaggttgagtgagatgagagtctagaactaacagttaggtttgatggtgtggaggccatcagtaaccttttctttcttttttttttttgagacagagtcttgctcagtcacccaggctggagtgcagtggcgcgatctctgctcactgcaagctccgcctcccaggttcacactattctcctgcctcagcctccggagtagctgggactacgggtgcccgccaccatgcccggctaatttttttttttttttgtatttttagtagagacggggtttcaccatgttagccaggttggtctcgatctcctgacctcgtgatccacccgcctcggcctcccaaagtgctgggattacaggtgtgagccaccgcgcccggcccaagagtaaccttttcaaaagcagctttgctctactgatttgggtaaaagcttagttgcagttggtttgggaggaaatgggagcagaaaatttgagagagtgagtgtagacaactctttcaaggaatttcgctataaatgggagtagagatctgaagactgaataattagcaaactgaaaagtgggaagacgtaattctcttattatttcatttttcttagtgaaataagaggtgaagttctctgagtaataggagggtcaaacaggtgttagaagttcacaaagaaaggaagaggtttgaaatagtcattttgagagtgggaaatgtagaagaattaacagtcattgctgagggtgcgtttgaaatctgtcatgagtttaaaataacttgtgtcatcatcgatgtgtttattttcaactatattcaactgcttgggtgtaggcatcaggtaggtaaaaaaagtgggttttattatgagtagaggttttgccacgtaattaccatggagggagggaagagcaaaggagttgagagtatagatacaaaggaatgattactgtaatgtgggtaagagaggaatggaaggctcagtgggcagtgggagtagggatgttgataggtaaggaaaaggtgataggatcaatgcatttggttctgcaagtgtcaaagtattgttggggaaagcatgctggaaggaaagatagggatgctggtgttctcagggtggaaggcttacagttgtagtctggaagtggtgattttattggcaattataaggtcaacggtatgactatggaattgagtggctaaggtctgttgaagaaaagattgtcggaaatgcaggggtcaaggaactggcctgtggatgttgaagtcactggcagtgatcaaggaatagtagtggagtgaaagtagttaatgaatcaggcactaagatctccaagggatgaaaggatgcagtttggagatgacaagataactgtagtaatcaggaatagcaggttttgtagctctgtctcataggcctcagaggagatgggcttttgaaggacaagagaaatgatgatgaataaattctaagcaggggaagtgtttgggaaagcagggcaggctttgtgctgttgatggcaaatgatgtaccagacaggatgaagttgagaatttggaagttgatcactgattagaaaggcttacattttattttggccgggggtggcagctcatgcctgtaatcccagcactttgggaggccaaggtgggcggatcccttaggccagaagttggagaccagcctggccaccattgcgaaacactgtctctactagaaatacaaaaaaaaaaaaaattagctggtcgtggtggcacatgcctgtagtcccagctactccgggggctagggaatgagaatagcttgaagccgggaggtggaggttgcagtgagccgagattgcgccactgcattccagcctgggtgacagagtgagactctgtctcaaaaaaaaaaaaaaggaagggcttacattttattttggtgctgactgggaatgaaggcaatgagggatgactgttggagaaggctgtgcttactaaacagtattattaagtagcagcatacatggtgttatactgacttctgattttgcaatagtacagacaggttcagattctcatttccaccttctccttctgcctaggtgaataactgctgggttatagtacagatgactgcagatcatttggaatttactttaaatgtaaacagtaaaaatttgaaagagagggaaagtgattgaggcaatttggggattgaataagaaggtctttttgttggaattcatttaaggaaagaaaatgaaaatttgatccctaatattatttaatgaagtggctaaatgaatatctctgctttgtggtttgaaaattaatattgattttttttccccctagaggaagaaatcctacttagcgacatgaacaaacagttgacttcaatctctgaggaagtgatggatctggctaagcatcttcctcatgctttcagtaaattggaaaacccacggaggttaaatattaccttttttttttttaacttaaatcaattctgtttatttttttatcacattttcctatatgtgaagaatactattcattaaggctgactcatagaaatttgcttgaatacacacacacagactgatgcataaatttgagaaatatctttccagttgttgaatagtgaatccaaaggtttaagccttttctgtctgctttgtaggatgttttatgaaacaaaggaatagaaattgtattcatattatacattttgaaattatatctatattatattttttgtcaaagcaaaataaattatacattaaggaaaatatttaagattcaaagttgtcattttctttctgttaatgagtatctttgatttaataacatttatagtttggtcacttgaaatctatagtgaccaaaagcaatgtcatatttagtagcctcatttctgttactatctgattattacttaagaattctacttaattaatagattattagaacaaaaggcattccaattttagagattcttttatggttaaagcactaggtaacttaaaaaatttggatcaaatgttatacagattaatagaccttggaatacaggggctatgtctttttggaatcagaccttgtcctggccttaattgcaggatgacttccttattaaatctctaaaagcaggaatgctctggaacaatgaacaattagaatgtggtaatgtaattttgggccaaaaaatactttgtagaaatgtgattctcttacttggaatagaaagaattctgactcgaaaaagtgcagttaatgtatgcttttctgggtaagatttgtgatagattttgattgagatttaaaaccatgatatataaatttagcttttttgtcaaagtaatttgccaccctagaatttgtgttggtaatttttaatgcaacttggacaatttctgaaagatgtaactttcttttttttgagacgagtctcgctttgttgcccaggctggagtgcagtgacatgatctcaggtcactgcaagctccgcctcccgggttcacaccattatcctgcctcagcctcccgagtagctgggactaccggcgcccgccaccccacctggctaatttttttttttatttttagtagagacggggtttcaccgtgttagccaggatcgtctcgatctccggacctcgtgatctgcccgcctcagcctcccaaagtgctgggattacaggcgttagccaccgcgcccagcctgaaagatgaactttaaaatggggaaggatactagtaaagccatttcttactcatgtatacatttttccctccatgaaattagagcagccaccttttacatgacttttacatgcatttcagatttttgtactagcaattaaaatatctactggatgtaaatcacatgtgcttaatgctttgcttcataatatctgttgaagtcaattaaaatatagagacagatctttaaattgaacatgttttatttgggaagcaagaattaaatttgaggcatatacacagactgggtgtccttggtatctctgaagaacaaagagaagtttggaggttatagaaaaaggaaaatgtgacattgtttttccagaaagttctttggcactagtaaattttggggagttggaagctctgatgggttagtgactgtggtgggtaaaactagtcttagagtcacaacaggttgtttcagtatctattagataaaacaggttttaggttacaataggcagtttcagcagctaggcttgcagaaaattacattcttagagtaatgttatgtgccttgagtgcttttttccccttggcccttgactctgatttagttgggtatgacaagaattatcaatttatataattactttttacatattgaagctgaataggttttcttaaaacttggaaatgggaaatactgggtcttgtgaagttttagtgtgaaaacgataactagtctcttatttcatgctctttgtaacaagtctacagtaatacctaatgtatctagatgacacctcagaaccaggagggaacaaaaaagacctctgagcagtcaaaataatgctataagcatgtattccagcttactttcggcatttctgtggagtgcaggaggccacattttgttcatagatccagtttgacaagcttgggtactgagttaaagtgaaaatggtgtaaataagtaatcatattcacatgacagtaggtggaagtgacagctgacaatctgaaagagtggacaaaactataaaaattagaactaagaactcttaaaatagaacggtttgaagtttgttacagaagggagcagctttatgcttcagtggactctgaaggtattggcagtgtatagtactgcttagtcattgatttaaattcggtatatatctcttctattgctgtcatgtacttgacattctgctgggtgctaaggctgtctgcaggctactaatatgcataataacaatcctgaaaaagaaggaaaagtatactgtgccttactgaagaaggcaggacagcctttggtatttgttagagtaaatattagttatcttacataaagcatgttatattccctgatgtcagggcctgataaatgagcccttacactcttgatagtcaatctgtgccactgttgctgtgtttgtatgttacaccatttcctgtccatgtaacagttaaactgtatcacatatctgttcctactaaactatttgcatataattttaacatttgagtggctgtatataaagctaaaagttctttataagatttatagcatcttagaatgtttaaattagataacattagtgtgcttttagtttttgaatttaattttgctcttgattttgtttgtgttaatgtagactttgtctacgtaagcttgagcccaactttggagtggtgttttcagtgatggaagtaactggaaataactcatgaaaccacttagtacttttgatagtttattcccatgaaggatcaaatttttacttgagtcattaatataaaaatttaaaagacatgtcagattttattaagcatggattttaaatatataaatattagaagacctaaacaaaatcgctaatgaaagagtaaaacatgtccctgcctatcatactcccttcactttcactgatttctgcttttatgaagtactttaataagctctacaacaaataaacaagacattgtgcctcattttacactctagcagtggttttccattccaactaactagattgggtttataatatagtcatttaaacttacttagttaaaatgttatacattagcaactgcaattaaggagctaagaaattcagctcgtatttatttatatgcatcttatccatagtttctcacttgttatatttgcctactgatggcaaattgattttttctgttccaaaaatgtagtgttttgagatttttggagatgcaaaacagcatcattttcaaattagatcacaaacaatcttacttgttgcagttgagactagtaattgatcagtgaggtgaaaaaattaggcaaaacggtatcatcaaaattttctttctttttttttttgaaacagagtattgctcttgtcgcccaggctggagtgcaatggcacgatctcagctcagctcactggggcccctacctacgggattcaagggattctcctgcctcagcctcctgagtagctgagattacaggcgcatgccaccaagcccagctaatttttgtatttttagtagagacagggttttgccatgttggccaggctggtctggaacttcagacctcaagtgattcacctgcctcagcctcccaaagtgctgggattacaggcatgaaccaccgtgcccgccccaaattttcttttaacttaaagtgttaatgtttgtttgttcccaatatttttatatatgtcaaggctttttcattatatacaggccagctctttggagttctgcatagtgtttcttgtttaaaccacacctataatgtaccatctacaatttccaattctttaagacagagtgaaaaattaagacacctgaagcaatctgagtgcggagtcctaggcattatgattttccttgacacttttagggttcttttatcacagtttatcaaacaccttttttttttttaacaaaaaacaaatttacaaaatctttccatgtattcaacttagaatttaatgaaatagggtttttttttttttggtggtcatgtatcatcaactttctttacatttaattaaattaatcaacaaaaaacatatagttgacataaacaaatttgggaccaagcactactgactcttagtaaacatacaagtcaactgttggtgcagaagtgccttgatgctagagagtagcctgcaagctgtaattatatatgggcattagggaatgaagaacagccttaatactattgatcttttaagtgaaggtcagcttagaaagcttttacttgttaaaaagcttcacagtttgtccttgtagttaatgcaattgaagttgaattaatctttcttaattttttttttagggtttctatcttactaaaggatatttcagaaaatctatattcactgaggaggatgataattgggtctactaacattgagactgaactgaggcccagcaataatttaaacttattatcctttgaagattcaactactgggggagtacaacagaaacaaattagagaacatgaagttttaattcacgttgaagatgaaacatgggacccaacacttgatcatttagctaaacatgatggagaagatgtacttggaaataaagtggaacgaaaagaagatggatttgaagatggagtagaagacaacaaattgaaagagaatatggaaagagcttgtttgatgtcgttagatattacagaacatgaactccaaattttggaacagcagtctcaggaagaatatcttagtgatattgcttataaatctactgaggtactaaataaagaggaagcacatttttagttattagtaggttctggcagactttattcccgtaaagagacagatagtaaatattttaggctttgtgggacatacagtctctgttgcagtaactcagttctgttattgtagtgtgaaagcagccacagacaaatgtaaacaaatgtgcctgtctttcaataaaactttatctacaaatacagatagtgggccacatttggcttgcgagctgtagtttgctgttcctgacttagtatgatatgcagcattgtgtagtggaaagattttatagtatcaacagacatttgtaggagtttgctattttataatttcgtatgcttttttcataatagatgtctctgctttttgtggattctcttcatatctactagtgtttactcttctgactttgatttttgggggtgtattttatttctttatacagaatttttttcttttttctttctttttttgagacaaggttttgctgtgtcaccccagctggagtgcagtggtgggatcttggccccctgcggtcttcaactcctgggcttaagcgatcctgtcacctcagcctccctagtagctgggaccacaggcctgcaccactacactcagctaatttttgtattttttgtagagatggggtttcgctctgttgcccagactggtctccaactcctggactcaagtgatccacctgccttggcctcccaaagtgttggaattataggtgtgagtcactgtgcctggcccagaatttctttacttgctcatgtgagagagtttctaataaactcctgatgcttttgcttgacactatagttttactgtcatctcagagtcagattttttccttaatttcttcattaaattgatttcttaatttctcatttgttttgcattagtttacaaaattacttaagatgcctatattctctgaaattttatattttatttcacgataaataagtttaaaaaattagatttgaccatttaattagagttatttccccatcatttttctaatggcaacaataattttagcatttgagcaattctctgtattttggtaactattagtaatcacttttatcagtataaacatgcatttcattttaaaatggttttcaaaatattctcataccaaccattcataaaagatgttccccttctgggaaatatcagtttttgctaacatctgcatttccctttgattttctaggaatttcttattaggtatacactttaagtgatatgtttcatataatattataggattatcaggatttcatgattttttttttttgagatggaatctatctctgtcgcccaagctggagtgccgtggcgcagtcttggctcactacaacctctgcctccccggttcaagtgattctcctacctcagcctcccgagtcactgggattacaggtgcccgccaccacacccggctaatttttgtatttttagtagagaaagtgctgggattacaggtgtgagccactgcacctggccttggatttcgtgatttgactgacatcttttacaccaattattgccatttttttattgggtactaattattagtattgctttctttattcgttaaataagaagtaaaagaacttttaaaaaataaaataactttttttcctagtacaaagcttattttcaattttttttattgcttaaattttgcaggttaattaaggctgtacttctttttcctacttcctgtttaaatatttggcattttttgagggttttctttctatggatttttgtgggggatcccatctcgttggacacttggttcctggagattgccaaattattgaaaagtttcctcatacccaaacattggcaatagactgaataaataacatctctgacattatttttcaattatatagagaatgctttttgtaaaatactgatttatttaaagatattacaatcatagtagttttttgcaatcttttttaaatcagtggatgtcaaggaacaactattgttctttgtacggcatttttcaacattgtgaagagttcttatactcaaaaagtttgggagacacagtgtgacattgtttaacctgagttgaacttgtcattttgtattcttgtttagagcagggattttattttgtctctttatctaactttgtattcctaactatttctttctttctctttggttctttgtttctttgttccattcttctctctctcccttttttatctatcatataaatatgtaaatatatattatatatccattagggaagaggaagttgtctaaagatatctagtatataggagctttgttctgcagaaaagaggatatgaagtcaattatattggaaattaatgcttaatactttttttaaagcatttatctcccaatgataatgaaaacgatacgtcctatgtaattgagagtgatgaagatttagaaatggagatgcttaaggtatgtttacaattataaaaatattacttcaagttctttccaaaggacatttaattaagtaaaatattaactaattctaaactaggttctaccacaatgaaattgctactaattatgtaacattagatttcacattttccaattcatgtttctttcatgtagtctataaataatgggttagaggtaatttactaattttaaatgtgctttccttgttccttcttattttttattttgaagacagggtctcactctatcacccaggctggagtgcagttgctccatctcggctcactgcaaccttcacctcctgggctcaagtgatcctcctgcataagcctcccgagtagctgggattatgggcgtgcaccaccatgcccggctaatttttatagttttagtagagacagggtctcaccatgttgtccttgctggtctcgaactctttacctcaagtaatccacccgccttggcctcccaaagtgctgggattacaggtgtgagccaccacacctggccttggatttcatgatttgactgacatcttttacacaaattattgccatttttttattgggtaccaattattagtattgttttctttattcgttaaataagaagtaaaataacttttttttaaaaaaagaacttttttcctagtaaaaagcttattttcaatttttttattgcttaaattttgcaggttaattaaggctgtgcttccttttcctactttctgtttaaatgtttggcattttttgagggttttctttctatggatttttgtgggggatcccatcttgttggacacttggttcctggagattgccaaattattgaaaagtttcctcatacccaaacattggcagtagactgaataaataacatctctgacactatttttcaattatatagagaatgctatttgtaaaatactgatttatttaaagatattacagtcagtagttttttgcaatctttttaaaatcagtggatgtcaaaaacagctattgttctttgtacagcatttttcaacattgtgaagagttcttatactcaaaaagtttgggagacacagtttgatattgtttaacctgagttgaacttgtcattttgtattcttgtttagagcagggattttattttgtctctttatctaactttgtattcctaactttctttctttctctttggttctttgtttctttgttcattcttctctctctcccttttttatctatcatataaatatgtaaatatatattatatatccattagggaagaggaagctgtctaaagatatctagtatataggagctttgttctgcagaaaagaggatatgaagtcaattatattggaaattaatgcttaatacttttttttaaagcatttatctcccaatgataatgaaaacgatacgtcctatgtaattgagagtgatgaagatttagaaatggagatgcttaaggtatgtttacaattataaaaacattacttcaagttctttccaaaggacatttaattaagtaaaatattaactaattctaaaccaggttccaccacaatgaaattgctactaattatgtaacattagatttcacattttccaattcatgtttcttttatgtagtctatgaataatgggttagaggtaatatactaattttaattgtgctttctttgttccttcttttttttttttttattttgagacagggtctcactctgtcacccaggctggggtgtagtggtgccatcttggctcactgcaaccttcacctccagggctgaagtgattctcctgcatgagcctcctgagtagctgggattacaggcgtgtgccaccatacccggcttatttttgtattttttgtagagatggggtttcaccatgttgcccaggatggtcttaaactcctgggctcaagtgatctactggcctcagcctcccagcgtgctggggattgcaggtgtgagccgccgcatccagccctgtgttccttcttgtgttactttcttgtaattttttcctggaatatgggtagtgatttggctctccagtattgaaattgagtttcctttcttccaattcatgtgtatccatttttatttggaagttttgtttttatacattcaataatcatctttactttctttggtattatttactatggatattttatattatataattttcaaatggattaaatggttcagttttactcttattattgagattgaaaatactagtttataatttatatattttctattcctttacctctaatttctttgtcaggtgttactaaccaaagatgtataataagaaaagccaatgtagctaaattaagtaaaaaatgaagaaaaacacagaagttccccattatgcatttttttattcctaatctttaggttgatgagatttttttatttttatgaaatgagattaatttattgacttttttagttttgaggccaagtaatgagtagtgagtaagaatgtatattctagggccaggcatggtggctcactcatgtaatctcagcactttgggaggccgaggcaggaggatcacttcattccaggagtttgagaccaacctgggcaacatggcaaaaccctctctctccagaaaaatacaagaattggctgggtgtggtggcatgtgcctttagtcccagctacttgggaggctgaggtgggaggatcacctggggagcctggggaggttgaggctgcagttagccatgaccatgccactgcactctagcctgggtgacagagtgagaccctgtctcaattaaaaaattaaaaaaaaaaaagtagattgtgaattcagatgtaggtttgtatcccagcttttccagttagtatctgtgtgactttggggaagtttcttagcatctttgatactcggttaacagttgtaattattatttaaggtattgcttgagaagagcttagtatagagcctgacatttagtaagtgtttaatacatattagctaacagtaaaactagaacataaatactgaattgtattttgttattaattatccatttctctgagaagtactgttccaatagtacatttataggaaacttgtggacgtctacaaacgtatacattaaatctcttagaaggcaacctggatgcccatattagagaactctattttaaacatgcattctaagtatgtttgtggacttgaataaaataaaacaaacagaaacacttctttcttctgccttcaggcttgaaatgaacatacttttttttaaaaaaaaaccttcaaaatgaaaatattaaataaaagatttaataaaaagagaaagtaaaaactgtagtttaataaagtcttcctgtctcttcatagttaaaaaatgttatagatgaaacaattttgaaatattcttgaaatagataatctttatttaggggagaatgtcagatactgtcaagccaaaataaaaacaaataactttatttcatgtttgtaaaattccttttctaaaatgatttgaatcttttgttgttttgacaattccaaaacacatttattgtttgctcatagtttcagccttattcagaaagaatgcgactgacacatgatatagagaaacttgttccaaaaataacattaaaatccacgtttactacttgagaatcgaaaatattgaggtgcaataaagaataaaatgttttaaattatccaaatttaaaatttatgatagctttccccaggggcagtttattatatgctattaatgagccttgtttatgctggaaatgttccatctttggccttgcgccttagaaaccattcatgagcacatatttaaaccggagcacacatgttcttttgtagtatggcttgcacatctgccagctttcgacaaaattgtaggccctgttaataatagtccttttgtgtttggtgaaaaagatacgacactgtcagtggttttgcttttaagatttcttttaaactttcagtctttagaaaacctcaatagtggcacggtagaaccaactcattctaaatgcttaaaaatggaaagaaatctgggtcttcctactaaagaagaagaagaagatgatgaaaatgaagctaatgaaggggaagaagatgatgataagggtaagcactgaagtatgtttgaaatgactcacctgtgatacctaccactgactttaacttaggatccagttttggatggtttggaggtcagggactttgtggcatatagttaattattggatccttataagcttttgtctccttagtgcttttgtctccataaagcacaatcttactacttagaaaaatagagtaatagcattatgatgataaaaatatctttccctttgtttttttgtatttctccaaatcattatagctctcatttagaattattaaagctgagaactctaacaatgaacttttattgtttagtggttaattatcttgattctttgttttgccctttcttggccactcaggaatctttcaagctcactgtggacagggaaagtgacttgggtagagctaacataacttcattgtgctgtgcagttagaattttgaccaaagatgtgggtaactaacttttcctaactaaatgacatttaggtaactaaactaaacgagattttcgtaactaaattttggtgtaactacatttagctttaggtaactaaaacgaagattttattttatctgtggatttttttagtgcgggactaatgtaatttctgattaccattaattgaaggttggttatattataacatttggattggtatattgcttgccatggtttgttctaaatgttagcctttagaagtattcctgattctaaaacatcagttttttttaatagtcctggcaaagtgtgaatcacaacaaaattctaatacttaaaagtaatccaagtgtcacagatggtacccagaagaccagtttgtattggaattaaaaaatagaaaacattaacccatggtagctgtcactgtattctttcaaagaagccaatgaaataaactgttttctccctctatgtggtgtttttctacttgaacataaatgcacattttattttatttccagactttttgtggccagcacccaatgaagagcaagttacttgcctcaagatgtactttggccattccagttttaaaccgtgagtataatctcatttaatcaaatcacatatttagtattctctttaaaacaagggaaaaggcaaataacctgtctgcttaacagcaacagcacaacttcactatagttatacatgccacactgtattttctgtgtgactacaaaattatttcaaagtgatatttatataaaattcatttctgcaaattgtttttataagtgaggaaaaatggttttcctttaactgagcagttctgagtagaaactagtttaaagatacttataaataaatgttaatttaatactgacttgtttttcattaaacgagtgtctatgtgcctgttttgtgtatattacccagaacatgcagatgtactagaagttcttaatacaacaatttgaggaatagtgataatcttatctattttaatgtactcaaaatttgtttacatctaacaggcacatttttgtgaggattaaatgagatgaataagaatgagatgaacaagtaaatgtgaataaaactaataagcctgtgaaaatctagactggatttttcctattctgagaatttaaaatataatccactgaagtatttctttccttttttcttttgatcttaaacattttttatttatgtcttacatacagaaaagtgcacatgttgtagagatcaatgaattgtcataaactgggcaccctgtggccagcacttagttaagaataggtcagtaacagcatgccagaagaccacctctccaattgatttttcccatgatattttattaagaaaattttctaagatgtagtaaagttgaaagaacttttttctgtgcatgtctgtattcccaccacctaaattcaactatcattactatacttgctttatcacatatccatccattcatatgtctctatccatccattcattcattccagttttaaaatgcatctcagggtcaatcgaggacaccattacacttccacctaagtatttcagcatgtaaattattaacgagttaaatatttacttaacagttttttctttggtgtaaaatttgcacgtaaggaaatataaaactttaagtgtacatttgcaaattttaaatatacatgtgcatacccatgtaacccaaattcttatcaagagatattattatcatcaccacacagagttcccttatttcccttttcagtcagtccttgtccctgagcatttctcttattattttaaagtattgattcttttggatatctagtatgaagcttagaatctgttttttactttagatgtatgtagtgaaatttaatatatataccaaatggtagttgttagttagcttgaatgggacattggtcaaatggcattgtttgttttaaagttccaggtttgtgcatttatgtatgaagtttgaaaataaattctatgagaggaaatgaaaaattgaatggattttaatttgtaccttgggtttcttattaataaaacaaaatagctttttgcttttcaccttcaagagttcagtggaaagtgattcattcagtattagaagaaagaagagataatgttgctgtcatggcaactggtaagttgtacttaagcaaaacctaatcctttaaaaaaataaaacataaagagtttgaaatgcttaatctttcattaaactctcaaaatacaaatgcaactacaaatgatgtaaactatagaagagagtgaacaaagaacagatgctcagatttatgtatcaattagcttttaggaagatagcatactagtattgaccattcatctgtataagtacattgtaaaaagaaatgaaagcatcaaaggtttatttttatttctatatttttttcattttatttttatatttttttcatttcaaggatatggaaagagtttgtgcttccagtatccacctgtttatgtaggcaagattggccttgttatctctccccttatttctctgatggaagaccaagtgctacagcttaagtaagtcatgttatcattgccacaatatcaccctctttttttcttctgtgggtgaaacatctgatccatcatgcatgttaaaatctagttcacaataacacatttctgcaggtattgctttatctttattggtaataaatgaccctttagtggaagagcttaccttctttcttgtgttctctgtaattcaaagctaccaggtggccctgataaaatttttttaaaaaacattattactttatgctggtttacattgaatatctcaaaattcttttctctttttgttacccttgctttttagcttgataagaagtgtatacatggaagtatattttttatctatgaaacacttttcagcttcttcaacctgagcttgcaatctgttttaaattgatacataatatctttacatattcatggggtactgtagtattttgatacactcatatcaaatacacttgatcaaatcagggcatttgttcatcaacttgaacatttatcatttctttgtgctgggaacatttctaatcttttctttgagttattttgaaatacacagtgttgttgttaactatagttaccctactgttggttaatgagtacaaacatacagttagaaggaataggttctagcaacctattcctttaccccctgtcatcccctgctgccctgagcttgcagtctctttcaaagacccaccttaaaaacttgcattctgataaggcccttgaaggaatttgcttatcaagttagtaagtgacaaaaaagaaaattgcaaagaacaggaatataaattattatatttctttattctttctcacttaagagtgaaattgatatgtgtaatgtgtacatggtgccagaatatttgtttttcttcttatagaatgtccaacatcccagcttgcttccttggatcagcacagtcagaaaatgttctaacagatattaaattgtgagtaatttttttccctcaacttttattttggatttatgggggtgcatatgcaagtttgttacgtgggtgaattacatgttgctgaggaagttgtgagtaatttatgtcatttctaatcatgtggtcagatgtctgtggtatatgagagaattttgtatacaaacaaattttactaaatgcatgaaaaaaaaagtccatgattttaaaatgcactttcttttgtacctttgcaggactgttactttttaaatccttcaaacttgaagaaatctgttattctcggttcttgggctataagattagcattgtactcatagaattataaaaattttggttttggaagagaagttggagaatataaagatttgtctcattttatagatgagaaaactgaggctcagagacaagtaatttgcccaaaatcacacaatgactggctgagcagggactggattctaggtctcttgcccaaccaattctatcatgatgtaattcctaaggagaatgtcatctcagatacacatacacacacccattttgtgtgtgtgtgtgtgtgtgtatatgtacacacacacacaaacatatgtacacttatatatacatacacacacatatattaatatatatgcatatatatgcatgttctaattcagaacattttcatcactcccaaaagaacacccctgcccattaagcagttgctttctttacgtatatattagtatatacatacacacgagatacacatatatttactgagttttgataaatgcatacaaagatgtaaaccaaacctctaacaagatacagaatatcactgacactctagaaagtttcttcatgtccctccccagtctgtccttccatcctccatcctaggcaagccactgctccgattttctctaccatagtttggtagaatgccatataaatgcagtcacacaatattaactcttttgtgtaagacttctttcatttgctgtaatgtttctgagattctttcatgctgttgcatgtatcagtagttttttgttttgttttgttttgtttttgttttttcagagtcagggtctccttctgtcacccaggctagagtacagtggcgcaatcatagcttactgcagcctctaactactgggctcaagctatcctcctgcctctcaagtaggctaggctgcaggtatgttccaccatgcctggctaattattaaattttttgtagagacaggatcttgcttggttgcccaggctggtcttgaactcctggcgtcaggattgtttccagttttggattattacaaataaagctgagacacatataagtctttgtatggacatatggtttcattttattgatacatgtcaaggagtgggatgactggatcgtgtggtggatatatgtttaactttcttttttctgagataaaattagaaggcgatcctcctgccttggctttccaaagtgccgggattacaggcgtgaaccaccgcacctgatgcagttgttgttgttgttgttgttttaatatctgattattattttattgtatttcattgaatatagcacagtttgtttttacattttcttattgatagacacctaggctatttttctggttttggactgttactaataaagctgctatacacatccttataaaaatcttttttgtgaacatgttttctttttttctaagcattttaaatcacctttattgaggtgtaattgacttacaataaattttatatgctgagaatgtataatttgataagttttgacacaggtatgcactcatgaaaccatcatcacaatccagataatgaacatattcatcacccacaaagtttacctttttgttttaaccccagtcaccgggtaactgctgagctccttcctgttactgtagactagtttgcattttctaaacttatatacatggagtcattcatattttatgtgctcttttttgtctgatttaaataatgcagtataattattttgagattcattcatgttattacagtgattaatagttcattcctcttattgttaagtggattacattttatggatatccaacaagttgtttatccattcacctgatagacatttggatcgtttccagttttgggttattacaaataaaactgctatgaacattcgtatgtaagtctttgtatggacatatgttttcattttattatatatgacggagcggaatgactggaacatgtgatgcatatatgtttaactttcttttttctaattgagataaaattcacagaacataacttttaccattttaatcattactaaagtccagtgggttttggtatagtaataatatataaccatcataattaattccagaacattttcctaactcccaaaagaaattccatacccattaaggagtcattccctattttcccttttcttttctttctttttttttttttttgagtcagggtctccctctgtctcccgggctggagtgcacttgcatgatcttggttcactgcatccttgatttcctgggctcaattgatcctcccacctcagtctcctgagtagctgggactgtaggcatatgttaccatacctggctaatttgttttattttgagtggagatgagattttgctatgttgcccaggttgctctcaaactcctgggctcaagtaattgtcccacctcagccttccaaaatgctgggattacaggcgtgagccactctgcccggcctattatctctgttctgcccacttccaaccactaatctactttctgtctctatgatttgcctattctggatgtttctataaattaacttatacattatatggccttttgtgtctggcatcttccacttagcatagtgatatcagtacttcattcggtctttttttatgactgaataatattccatagtatgggcatacacattttaaaaattcattcatcagtgatggacatttgggttgtttcctttttggctgttatgaataatgatgctgtgaacatttgtgtaccaatttttttatgaacatacattttcaacgcttttgcatatatgcctaagagtggaattgctgggctatatgctaattttttaagaaactatgaagcttttgagagtgattgtatcatgggatattcccaccagcagtgtatgagaggtccagttcctccccatccttgctatcacttagtctggctgatctttaacttaagccattctaatagtatctcattgtatttttagtttgcttttccctaatgactaattatattgagcatttttcatacacttattggccatctgtatatcttctttgagggagtatctgttcaaatcttttgcctattttttcttagtgagttttgatagtcatttctatattctgaatataaattatttatttgatatatgctttgcaaacattttctcctagtttatggcttttcatactttccacacagttcttttgaagagcagcagtttttcattttgataaagtccagtttgtcgattcgttcttttagggattttgcttttagtgttttgacccaaggtcacaaagatttgcttttatgttttctcctaaaagttttatagttttaagttttacatttagatttacgattcatttttagtaaatgttgtctattgtatgaggtattgattacagtttatgtatttttcacatattgttccagctccattttttaaaaagactatgcttttacactgaattgactttgtacctttgtcaaaaataaattgactacatatatgtgggtctattgctgcactctctattctgtgttctgtggatctatttgtctgtcttgattggtgtcttgattactgtagctttataataaacctggaaatcaggtagcgcaaggcctcttgctttgctcttttctttcaaagttgttctggctattctatgtcctttgtatttctgtgagcatgtcagcatcaccttttcaacccatatgcctgctgggattttgaatgagtttaccttgaatctagatatcgaaacaattagctgtcttgatagttattgtcaccgttttataccgaagaaactaggcatactaaagtaacttggctaacatcacttaccttgtaagaagtagaactgggctgtttgacatcagagcttattctttataccatttcctatgttaattagaatacaatattaatttcataaaggtaaaggcatatctgttttgttcctatttgattccttgtgaaagcacaatgcctagcgcacaatagacacttaaacttatctgttgaatggacaggtgaatgcttttaaagtctttccatatagaaaattaagtttcattacatttgacttgatctaggttttcatttcatagaatggagagcagactctgtaaatattttgccccagacctagccttattacaaacattgtcttaattaggattctgtctacccagaatagaaattaactcaagctagcatgagtgtatattgaaatttatattaaggataaaggaatgtctcatagatcccactcaaaagaaattagccagcccttaggaagagactggaattgggtttggaaaatacaataggtctttctttttatctgtagtctttagtgagtcttcctcatttttctctctgaagagataagcattctctgcatatatatagcattcttttagattttcgtgacataaagtattatttaaactttcataaggtatcttgattttaagttgtaattccttgagatgattgttttctttattgttaatatgtttcccttcctgtttttttttttttcttttttcttttgtttgtttttacagaggtaaataccggattgtatacgtaactccagaatactgttcaggtaacatgggcctgctccagcaacttgaggctgatattggtaagtgataaagaaagatctctgtaaatacttactgagttaatatttaaagttaaacctatggatggacactggatttcacttctgttaaagtttatttcaaacattacttcctccaggaaatctctgactctctaacttgctgtttcacctatcttatcccatgatactctataattccttttgctatagaaattaggctctgttatcataattacctgtttatatatctgttttcttctgctaggctataaacttttcaagggaaaaatatcactttttaaaatttatgtttccccagtgcagtgcttggcatataggcacttaaacatattgttgaatgaatgttgaatcctaggttctgtgaaattttaatttacttgtttttcatgttctgtatctaaattaagtcagtgtagtggttttgtaccctctttgttcataagaatcacttttcaaactttaaaaaaaatgtaggtaaccaacacccaactctgaaaattctgatttaacaggcctgggttggcacctggcattggtggtttctcacaggtgattctgatatatagcccgggttggaaaccacagtacctttgattagttgccactagtgagtatgatttattacaaaaaccaaaaacttagataagtcacagtttatttcctagaacgtgtaaatatagaattagtcaaaagctgatagcactttttttgtacttaaaaatattttaagcctcagtatagtgagacctcatctctacaaataattttttaaaaaattggccgagcctggtggtgcatgcccatagtccaagctacttgggaggctgaggtaggaggattgtttgagcctgggagatgaaggctgcggtgagccaagatcatgctactgcactccatcctgggcaacagagcgagaccatgcctcaaaaaaaatttttttttcttcttggtggttaggcttaactatccaagaattgcaatcatggcttctattgcaaatgcccctatttcccaccttcagttggcctaaccaaatttaatttttcaatatcatatgatctttttgtataattatgtattcaaataattccagataggttaggttttcgaattgcaacgtctcatttaatggttactttcatataactgtaggaaagcatttgataatttttccaacaatgtaatgaaaacaaacttgtatcttttttattatgtgttaaaaccaacaaaagaatgagggcagcaattaacatttcattaaatatattagcaatgagtacatttatgagctcttaaactcccttattgacatactgtattttttgcctttaatggacaatgaatttgatatgtttcctaataggttgtatgaagttattgtgaatatttcactttggattaagaataactaccctatatataaatttcatggttgtattgcaaaagctggggtctatgtccatagtggtttgggtacgtttttactatttgctttgtttctgtgatagtgttaaatgaataataagcttaagtatttaagcaaatacttaatacttctgacaagtagttagaactctctatttttgtttttttgtaatggatgagttatggacactgcaattattagagcagcgtactttgcttatgatggatgaaaatgttctctggttgactcagtgttgaataaaaagggatacatgaaataaaaattatttttgaaatattttcctttgccttttgttgcgggaaattgtacaatgcttgcaaaaatgaatatacgcaggatattatttgtacagcagtctgacatttagctaatcagattcctcatttttaggtaaatgttaaattacttaagtagtctggatttttaacagaaacagcaaacatagttttatagggaggctccttaccaaccagacttttaacttaagtgaatgttggcaaaagcttgtctaaactgatttccagggataaggtttagctccattaaaagctagtttgtcaaacctgtaactaaagctttttaaaaaatgaaagttttaaaagagaccatcattctgttttaacctatttaatttaaaatctgggctgaagtaggagtattgcttgaacccaggagttcgagaccagcctgggcaacacagtgagaccccatctctgaaaaaaaaaaatgagctgagcatggtacctgttacagtgctagttatgaaagaaagaaagagagagagagagaaggaaggaagggagaaaggaaggaaggggctgggagtggtggctcacacctgtaatcccagcactttgggaggccgaggcgggtggatcatgaggtcaggagatcgagaccatcctggcgaacatggtgaaaccctgtctctactaaaaatacaaaaagaaaaaattagccgggcatggtggtgggtgcctgtagtcccagctactggggagggtaaggcaggagaatggcatgaacccgggaggcagagcttgcagtgagccgagattgcgccactgcactttagcctaagaaaaggaaggaaggaaggaaggaaggaaggaaggaaaaatcagtcactcactcaggtttagtttcaaaagccaaaacagtgataatattgaattttttccagccactcagtagtacccagagaattttgatacaaataactgactttgaccccatgtttagtaggttttttttttgtttgtttgtttgttttttttttttgtctttcttctccacactctcttaggactgttgtagcttgtaatgttagtgaattgtaattgtttatttgcatgtctgtctcctcttttagaattgtgaactcctcaggtcatggattgtattttattagtctttttattcctagaaaagtgtttggataataatagatatttattaaccataataggagtagtagcatttttgtgtgtgtgtgccaggccctattttagcattttatgtgaatgatataatttaatttttagagcatctagaaaatgttaggtaccattattatccacattttacttgtgagaggactgagacttggaaagcttaagtaacttgcttaaggtaatacacatggcagatggtggagccaggttctgcatctgggcagtctgactttagagctttttaatcatcctcctcctagtgtccgaacattattaatgctcagagaagtatcaaagaatgatgatactcattgagggaaaaaattattcttaagtatcaatttgttaattgaggacaaaagcactactgttactactgtgaaaaatctgaaaacattgtcacggatgattttacaataacatccttttctgacatgcattacaacacactattgattccgtttcaatgtttgtgtctggtatgggggcggagtagagaggctactacaggaagaaagaacaaataacatttcttcttactactttgtgcatcatgtgatttagctcctcccataccattttacattagaaaatgtggctgtcctcctgtgctctagtactggcatttcagaggactctttgcaatatgatatgtgatcaatcatggatggcgatgcagttaatttcagtagaaatttgctgactctttttatctcttttaatagctaatgcatgagataaaattgaaggtattaccaaggagaaatgcaggtggatagttttggaggcaaagtcacagtaagcaattcatctctccaaggaatagtgatgaaagctgagatccaataaatgtcttgtttggattaatacataaatatttccttttaaaattcttaaggcttttattcatatatctcccctctccctatttccaataatgatttttggtgttaatatgatgatatttatgcttctgtttttataggaaccaaatactttgatttggttatttattctcctttggagatgtagatgagtttattttttcctttcgagctttatcttttcctttatgtgtttttcttttttacaggtatcacgctcattgctgtggatgaggctcactgtatttctgagtgggggcatgattttagggattcattcaggaagttgggctccctaaagacagcactgccaatggtaagctttgccaagtctgatgtcccgaaattacattcttaataaggagagcattcaggattggggagtggtaaagaagctgaagacttcactataaaagagcaaatggataatgtaaaaagagaactatttttttaaaaatgctaaagttggtatataatctattgaggaatataatagaacaaggcttgacaaaccttttctgaaaggaccagataataaatatttcaagctttataggccacatgtagtctgtatcacatattcctctctctgttttttcttttagtaaccctttaaaaatataaagagttacatttttcactggtgggccataacaaaacaggctgtgggccatatttgtccgaatgtcttctcagtgatctttcatccgtatgtccttttactctaggatgctgtgaaatcctggttaccccttcttgtatcacattgaaaacctaaagtttgaactattctatagaaattttattaaagcttttggtattagaatttccctttcttccctaattataaaaaatagcaaattttggccgggcatggtggctcacgcctgtagtcccagcactttgggaggccgaggtgggtggatcacctgaggtcaggagttcgagaccagcctggtcaacatggtgaaaccctgtctctactaaaaatacaacaattagctgggcgtggtggcaggtgcctgtaatcccagctacttgggaggctgaggcaggggaattgcttgaactcgggaggtggaggttgcagtgagccgagattgtgccattccactccagcctgggcaacaagagcgaaactctgtctcaaaaaaaaaaaaaaaaaaaaaaaaagtgaatttttacatgaatattctacatgattggcatatttacatgaatggtttaaaaacccacaataatagcactgttttattttttattttgaaaattgtagattcacaagaagttgtaaaaaaaaaaatacctatatagaggtcctatgtacctttcatccagtttcctgaacagtaacatcttgtgtgactatagtacaatatcaaaactaggaatatgacatttgtacagtatctagagtttattcctatttctctagttttgtaagtactcttttgtatggcatgtgtattgttctatacagtttaatctcatgtacatttgtgtaactaccactgcagtcaggatgccaaatgttcccttaccacaaagctccctggagctgttcttcccacccctggccctagccactggcaaccacaaatctggtctctatctctaaaatattatttcaagaatgttatatacatggaatcatgcaatttgtcaccttttggaattagtttttttcactcaacataactaccttgagatctatccaagttgtttgtggtcatgtgttgcctaacaacagggatatgttctgagaaatgtgttcttaggacattttgtggttgtctgaacatggacttacacaaacctacatgataaagcttactgcacacctaggctatatgatagagcctattgctcctaggctgtaaacctgtacagatgttactgtaatgaatattgcaggcaattgtaatacaatggtaagtatttgtgtatctaaacttatctaatgtagaaaaggcacagtaaaaatacagtataaaagataaaagatggtatacctgtatagggtgcttcctgtgaatggagcttgtaggactggaagttgctctgagtgagtgagggagtggcgagtgaatgtaaaggcctaggacattactgtacactactgtagactttatacatattgtacacttaggcgacactaaatttttaaaattttctttaaaaattttctttcttcaataataaattaatctcagtttactgtaactttaattcataaacctaaaacattttttgactttggactcttgtaataattcttagattaaaacatgaacacattgtacagctgtacaaaaattttttcttccttgattaatgcattccataaggctttattttaaaattttattatttttatttttaaaacttttttgttaaaaactaaaatacacacatatcagactagacctacacagggtcaggatcatcaatgttgctgtcttccacctccacgtcttatcccactggaagttctttaggggcagtaacactcatggagctgtcatctgtgataacaatgccttctcctagatacctcctgaaggacctgcctgaggctgtttttcagttaactttaaaaaatgaatacgtaggaggagtatactctaaaataatggaaaagggtataggtaaatacgtaaaccagtaacatacttgtttattattcatcaagttatatactgtatataattgtatgtgctatactttttaatgcctggtagtgcagtaggtttattgacagcagcatcaccacaaacgtgagcagtgccttgtgctaagacattatgctggctatgacatcacttggtgataggaatttttcagctccattataatcttatgggaccactgttccacatgtgctctgtcattgacagaaatgccgttaagtaccacatgactatttttcggtggtctgttcctttttattattacagagtattccacagtatggttgtaccacagtttaactgatcacctgttgaagaacttttgggttgttttccagtttttgactattatgaataaagatgctatgaacatttgttcatatctcaaaggttctttatttttttttatttatttttctttttttgagacagtctggttctgtcaccctggctggaatgcagtggcgcgatctcggctcgctgcaagctccgcctcctgggttcacgccattctcctgcctcagcctcccgagtagctgagactacaggcgcccgccactgtgcccggctaattttttgtatttttagtagaggcagcgtttcaccgtgttagccaggatggtctcgatctcctgacctcgtgatccacctgcctcggcctcccaaagtgctgggattacaggcgtgagccactgcgcccggccttcagagattctttaatgggtgaatggttaaacaacctgaaaatataaaagttttcatttctctgggataaatgtccaggagtgtatttttagtttttaaggaattgtcacaaacctgttttccaaagtggctgtagcattctacattcctgtcagcagtgtgtgaatgatctagttatccttgccaccgtttgttgttgcaactgttttttattttagccatttcgataggtgtcgagtggtatctcacttttaatttgcatttctctcatggctaatgatggtgaacgtcttttcatatactaatttgcctctggtgaaatttcttacataattggagtgcttgtttttttctgttgagttttaagagtttaaaaaatacattgtagatatgagtccttggtcagatacgtggtttcaaatatttctttcactttgtagcttgccttttcattctttttaccgtgtctttcacagagtaaatatttaacattttagtgaaatccagtttatcattttttcttttatggattgtgctcttcacctagccctagatcctgaagattttctcctgtggttctttcctaaaattgttacagttttatgttttaagtctgtgatccattttgagttaaattttgtataaggtgtgaggtttaagtcaaggttcattgttttcccaatagattaaattgcagcagatcctttgttgaataggctgtccttcccctgttaaattgcgtttgcccctttgttgaaagtcatgtgggtgtatttgtgtgggtctatttctgggttctctagcctgttatattaattttgaacgaataaagttggcttatgtttaagttttcttggtagtagcgaggcaatggtgccttctgagcccaggatttcacaattttgtgagtaaactgtgttagaaattgtttgttattcttttggtaggttgtctagttcaatttcattgctcattaatcttgcttatagatagcaaattgagaggcatctcaaaaatagtatcttttgttagcttatctcacagagtttggttggagcagatattaaaacagaacaaaccaaaaataaattaaatatactagttagcaagtttatattgagggaaaatcaaaccatgtgaattgagctccaatgatgtggctggccttgggtcagattttagtatcatggttcaacaaggtagctattaaaatcttcatactttttcttgaaataattctttagtagtcacataggacagcacacactcatggatttcttctttccttactgtctctttattctcagcctcctgttccttctcatctccctgaccttttaatgttggccttccagaaactttagtctttggacctacctttgcactcattttcttggtcatttcacccaacatacagttttatgttattttatttttttatttttgagatggagtttcactcttgttgcccaggctggagtgcaatggcgtgaactcacctcactgcaacctctgcctcccgggttcaagcgattcttctgctcagcctccccagtagttaggattataggtacgtgccaccatgcctagctaattttgtatttttagtagagatggggtttcaccatattggccaggctggtctcgaactcctgacctcaggtgatccacctgccttggcttgccaaagtgctgagattacagatgtgagccaccacgtccagcctacagttttaaatatcaagtctatactgaggactcccaaatttttatctccatcatagactgatatcagcagtatatgagtgattcagttgtttttgcctctttgccagcatttggtgttgtcactattagttcattttagccatttaatagaatatatgtacatatatatgtgtgtatacacaggcacacatctatataactactcaacatgcctctggtgagatgaccaacaggtatctcaaacttaacctcttcctaattgacttctgcatagcactccagatctgctctttcctcactctcctccatcttgtttaacagcagctccattggccaaaattttggaattttcctcaatcttttctctttttcttacactccactgtttatttaaacagtaaggaaatctcgtgaggtcttcagaatatatgcagaattaaatcacttctctcttgatccctgccattccccaggtacgggccaccatctccttagggcctcctgctttcactcttcccatccctcattctgtttcaacacagcgtccagagtgatactttaaaaatgaagtctgatagatcatgtcttcggctcagaaccatctagtagcatgccatttcattctaaataaaggcaaaagtccttatgatgagttaccgatcctcatgtaatctggccttccattttccctctgatctcattctctactggtctcctcattcaccggatgcagccacaccaccctccttgtttttcttcggacattccaggcatgcttcagtgcctgggctttgcgcctgctgcttcctctccctgaatacgtttcccccacattgtctataggatgttctcccatacttctctcagatctcttggatttaggcctcctgggccaccatatttgaaatatcagattagttccccctcccccatcattcagcattcctcgtaaatctttgctgttttaaaaatagcactatcactgtctaacttactgtgttatattttgttaattttctgtgagttcttcttcactagaatattctttgtagggaggagtttttgattgtttggtttataaaatctggaacaatacctggcttataggaggtgctcaatttataatggggtgaatgaatgaatgaatgatgatgagaaagctgagaatcagtaaagtgactttccaaaacaggtagtgggcagtatagagttgggccataaatagctgcaccatacaacatcctgctagtttctaaagcaaatgatttgaaagaggcataaaacataatttctgccctcaggtagctcatagttcagtaaaggagtttagattcatacctataacagtagaagtaatagcaccaaatgaaatatggtattatgaagtggtacaaataatataaaaagatgaacagtgttagtagtacatgtttagaagggatttctgtggtgaaagtcactaggcacagtgcacctggaggaccgatttccattccatttagaatggtttaaagtaagcttttggaaactaggaagattactttctgtaatcctttcctaggcctttgattctagaaggattgtgttaaaggagttttaaatattttatacagttcttaaacattgttaagcttgaattaaatcttttattatgtctggccatggacgtcattggatcattttcatttcttgggaggattaataaagcacattccttctgttgggcctccagtgcggggagggtgttggccgagcagtggctgagaaaacgtttttcccctggtgttttcaagaaccctctttattagctaagtggtgagacatgccacctggtggttatagtagtatcatttttctcactgttcttggtgcttttcttctccttctgattccagttatactaggacaactgctataaacctggaatgtttcacactatattatttcagtaatttcaaaaacagcagaaatcactaagctgtttggcacaaagattcctatttggaaggaatcagacaaagtgagtgttgagaaagaacagccaggcagaaagctttgcatcagtcttaaagttctttacatttcaagtaagaggaattgtgaaatccataagacatgtggggtttttctattactttctccccagtatctattacaaagatcagcacatagtaggtactcagtaactatttagaatgagtgcatgaatgaatgaagtatgtgtgatgttatggagtacaaagttagaattagcaacatgacctgaatttagaagcaggtgggatacttatacttttctcagtctgtgggcaccacaccattgaagtatatgtctaagattaatttatatttggttgtttgatttagcaaaacttgctgcctgttaaaaaagaaattaagacctgtcaacttaaagaatacattttgtgagttaagaactaaatgacagtataatttattacccaaagcagtttgcttctgaaaattaaagagttcaagctattaataattatgctgtgactgcaggcataaactgggaatgtcctggcaaatgaggatgtattgtcacctttctcagcctgcctgtgtgttgtttttaagcttcactctagtttatatattttaaatgtcataaaataccacatacttataagagaaaaggttctattcattgctgaagtggaagcttatcattaatttttatttatttatttttttttccagttttggaattcttattactttgaacccaagaaccactgataactagcacaatccagtgaaacagaggaagcagcagcttaatcaaaggaaaaatacatttaagattataagtctggttataagcttaaaaagtgacccagaaagggatatcattgctaaaaaaaaaaatccccttgtgacctgggtacattttgcaaagccacaggtttgcagtgttacacaagggccaaaggaggccatgagttgtctttggttgtggggccggagggtaactgttcatgaaaatagtgagtgtctgaagattaagaaaatcatgctgcagcagaggagaagggagaggaaggcaggaagggaaaggagatgcctgagggtcaaaagctgagcccaagcctaagcccaagctcaagttcaagccccagcatggcacaattttgtgaattaactcaggctgagttgcctccagtctttggaatgtcatcttatactggtactgctgaggcagagggcagtaattggttctttgggataggagaaggggcagttgctgaaatacaaaattaatagtcagcatcccaagttcctcaattgcagccaaaatacatgtgttcaggcctttcggcagtaccgcccccagaactaccagctgtagtgtggtctattcccagacagcaacatgcaagaataagtttacaatacactcagcccttgtggcttaagatcaggggctcagaggctgtgacaactcatgatgctgaaaatgtatccaatgaaaacgaagtactagctcgtttagtagtaacgaagtactattaatttttaatatagtctgatactttattttctaattgtagaagcaacattcttagctatatctttctagaatgttgaggcaaaagagtaaatttatagtgattttcactgttaccagattgctggaatagggaatttctggtagcaagatgggaatttttaagttggaagggtctaacacatcatatagccgtctccatctcattttttttgctgaaaaaactgagcccttgcaaatgtcagttgcaaatctgggagtagtactcatgtctctgaagttgttatatagaattctttttatttattttaataacaatatttatgatagttgaaactttttgagtgcttactatattttatttcatgcattatgttcagcactttacatgttttatctcacttgatattcacaactttatgagattggcactgttattgtagccattttatagatgaggaaactgaagcttagagagttaaataaagagctcaaaatctcacatctagtaagtggcaaaaacaggatttcagctcaagcaatctgattccaaaacagacttttttcactgtgctgccattcttttgcctggtttttctgttaacttcttaaatatatgtcatgtttcatgcttacttcctcattttcataaatatattacctgctcacttatacattatattgcttagaaacaaacccaaccctgttttcttatggactgtatcctgaaaatcactgtttttaatatgtggttaaacaagtgttttattagtgcatttatataaattatttaaccaaaacacttaaccggtgaaagtgctttactgtgagagtgagaatgtgcatgttctaagaacctctaatttttaaacctcccttattctcagccttatatttgttaaaacctgtgtgttaacacagatgcacccatgttaggggttaattagagaaaccaacctctttatagattagcttgttcatctttaagttgctaggcaggcactgtaaattcagagaacaatctgattgtaagccacaaatcaatgaaattaattttggggttgccttttaaaatagtgtcacaaaatttaaggataaagaatgcaaaaatgatgccaattatctcatcacattagttttgatttaatttttttaatttgaaaaaacctactcttaaacttaattgatttttttaaatataagtttggagataatttttaattcagtaaagttatagtgattgaaaaagtagtttataatttttaataaattgatcttgttttaattttgagtcatattctagaagtgcttctttgcaaattggtaaattgcacatacatttccacttatatacaagataattgctatggttggtttgtataatagatgcagtgcatctgaagagctattttatgagaatattgtttcttgtatctgtcacgagccaaaaagaatatttttaagaaagttatattcttggtgatagaacagctgataatttagaaacaactgtaagacagtccactttttctgattatgaaataataccatagttaagtgtaatttcctataatagaataaaaacacgagttctagttttaggggaggcatgttgttaccgtaccttagaatttctggaagatgacatattcatgcttttcctgataactgctgagtctcctgctctgtctgccaatccagtcaagaagcctttgctagcaatcaattaataatacgtttcatttatacatatttcctatatatagtatgttattgattatctcagtaccactgaagagaggttatctgggtcattggagctttgcttctagatttgtgaagccataaacctatatatttaaaataggaggccaaaaaaaaacgaccattgctttatatagttagattttcagtgaattgagagtttatcatttgtaattatacattaatcaaatataaggcataatatacccccctgcttatatcagcaccatttcaaatgtaatgttaaaaaataataaatggagaagtagatagctaacaagtaggcttaatttaataagacaaagtaaatggcatttggaaacctcatggatttaatgttttatttaaatgatttctgatttttaaaaagtaaatattgtatccagaaggctgagaaacaagttagtagggagattttttctttgcaaaaaaattttacagttgtgtctttaacattgtaccacaaactgttgtcctaccagtctctttgtaagaaagctatagacatgttgggaatgaatgagctctttcctttttaaaatatcagttttacatcattcaggttccaatcgttgcacttactgctactgcaagttcttcaatccgggaagacattgtacgttgcttaaatctgagaaatcctcagatcacctgtactggttttgatcgaccaaacctgtatttagaagttaggcgaaaaacagggaatatccttcaggatctgcagccatttcttgtcaaaacaaggtaaggatttaatggttgatgaattttggtaatgatttcctttttttttttttaacaacttatgtattttatgttatttacgatttccttctaatgcatatttaacatatttcaaattccacctagttttggttcaagtcaagcatgatgttatataatcaattcagtgattgagactagtgtatttttaaaagcagaaaccaattctcctaatattttaataccccattctgttgcttaaacagggcatatactatttatttttattttttaaaattttacttatttatttatagagacagggtctctctgtcgtccaggctggagtgcagtggtgtgatcacaactcactgcagcctcaaactcctgggttcaagcagtcctcctgcctcagtctcccaagtagctggaactacagtcttgcaccaccatgcctggctaggacatatacttttaatgattgataagtaaacaagcaaacataaaatgactctttcatctgaattctgtctagtttactaattacatgacttcagtcttaaggagcttagaaaaggtcaccttacaaacacagtggagcctgtattgtgttccaaggactattgtaggcgctttctatataaaatgatctaatttaatccctataactgctcagtaagttacgtattattttcattttattgttgaggaaactggcattagtacttttttctgtttattttgtttaaaggcattttaaatatatatgttaagaagttttcaaaagcctatattttactttttataagcctttattttactatttgagacagtgtcttgctctgtcacccaggctggagtgcagtggcgcaatcccggctcactacaacttccacctcctgggttcaagctattctcctgcctcagtctcccaagtagctgaaattacaggtgtgcgccaccatgccaggctaatttttgtattttttagtggagacggggtttcaccatggtggccaggctgatctcgaactcctgacctcaagtgatccacctgtgttggccttccaaagtgctggaattacaggtgttggccactgcgcctggccagtttataattttaaacattaaaataaatgcttcttgtccaatcatggtgtctcacacccataatcccagcactttgggaggcagacgttggagaatcacttgaggccaggagttcgagaccagcctgggcaacatggtgaatccctgtctctacaaaaaatacaaaaattagctgggcatggtggtgcatgcctgtagtcccagctatttgggaggctgaggtgggaggatcatttgagcccaggatgttggggctgcagtgagctgagatcacaccactgtactccaggctggatgacagagcaaggccccgtttcaaaaaaaaaaaaaaagcttctaccaatacaaacacaaaacaagcatagacaaatagagtttaaagaacatcattggtgttttcctctaaagggaatattgatgctaggccaagaaaatcctggagttattcttgaggaccttaaggaataattgaaatgtaggatttgctcctggctttcttgtcctatattcagaataaaacaagaatggatcgaatatattctgagtgttctggccattctagtgctctctgaagtgagtactcactgtgtttcacttccctttcatcctaaagaggaaaagttcttttgaagaaggctgtttgtcctaggttagagtctccacagtcagatcattatctcctcctaatctttgatcctgttcagtctctatggtactttcccttataataacactctctatggcactttcccttataataacactctcctttttaaagcagtttgccttttttgtgtgtaatattgttctcctggttttctgacgtcctggtcctcttataatcctatgcaaatgtttctttctgtttttcatgttgactctgctaattgaggtctttgttactttttagccgagactattataatttccccaacagatatccctctccccagtgccccttgttgctttctatgcagtttacaaattattgtctgcaaacacatccttaagtctggaatacctttctggaactccttactaggaaataaagaccagactcagtgtaacattcaacagtattgaagatctaggtatttaatatgaatttttttttttaaggagatcaagaaagatttttgtacccatttttaatcctccaagaagacttaggatagcaggaaaccattgagagtcagaatgctttctacagatcttaggtgaacagaaactttcctcttcatgagcagtgaggtagagggtaattaaggcttcagagcattgcccgttatttccatcttcttcccttcctttaattctgctaaattcctttaatttgtttatcagtattcaagtatttttatccattgagctaaggtgtttcttaaactaaccctattttgttaaagtcttaattataatatattcatagtacatttaagtgagatagatgagtctctcatataatttagtggttagattagattagaattttctcccctcagaaaattaagaggaaataaaagtctgtagcaaatcacttggcaaaataatggctccttttgtaataggaatttttactcttttgatttatctgttacataagttcaaatttttacatattttccaccttttttaaaaaagagtgatatgtagtcaatatcaatttgagcaacactgttgcatataaattgaaaaggactccaattttctaattccgtacctcagttgtgatcactgttggtattttggcatttatgtagacttcctttctctgaccctactactgtgcagatatatagttgcagttttttgttgttgttaagttgatacagaaatagttgcatactatatccattatttatgcaaattttttttcatttaaagtatctgctatctttccatatattgcattttcttaaattagagccttaatatataggatattacaatatctaggttttgttgagtagttttttcttctttgaaaacatgtttttaaaataagatttttttttttttttttttgacatggagtcttgctctgtcgcccaggctgtaatgcagtggcgggatcttggctcgttgcagcctctgcctcctgggttccagcgattctcctgcctcagcctcctgggtagctgggattacaggtgcatgccaccatgccctgctaatttttgtatttttagtagagacggggtttcaccttgttggccaggctggtctcgaacttctgagctcaggtaatccgcccgccttggcatcccaaagtgctgggattacaggcgtgagccactgtgctggccttaaaataagatttttatacactaaaagaaaacttacatttttcactccattaagtagttcactgtgaatttttgatattgaagcccatttggttgctgtcaaaaatagatttgaacagattattcagtatgactcttgtagtgaaattattgccttgtttcctctgcttaagttttcagtggcttttgccacagtccttaaaggttttataatttttttaatgtttaatttttaaatgtttgcttaatatttcttagtatgagtgtagataatgatgaacatttagatgactttttactattataatgttgcagtgaatatttgtttacatttatcttttggccaataagcaaatatttttgtaaattagaatcctaaaattgaaattggatcaaaagttatatgcacttgaaattgattaacttttcctaaatctaaaatagtatagtcttttttatattgtcagcataaatgaatgcacttatgtaaatgaatatttttaggcgttaagtaaaatattctgtggaaattgaacatttaagttgtttatacttctatggaaatcgtttacgcttttaataaagaagcacaagtttctacaaaatacattctaacagatgttttctataacattcagtctcaagattactagtaaatacttctttgaactgtaaaagcaatctttcaatattataagaaagctcttgctttagtaaacatttagaaactcagctttattatcataagcaagaataagaacagtgtaacaagttttatgcacactcctttgtaaaccctcaccagactaattgttaatctggtgccttgcattccccaaagtatttgtatctgtcgtttataagtttttatcaaggtttcagctaaaacaaataaatttgtttctggttttagctttaatttgaactgaaacagtcaaaactgagttttggggacttcacacaattcatttggatatttgattctccataatgttttaaattttcatgcacttaaatatatcattatttttgataggctttcttcctttagtcttttctttagaaggtagaaaggaagaattaaataagataaaaccaaacgggtctgaagcatgtataaagtatatatgtttgctcttttgttcttctttttctttagttcccactgggaatttgaaggtccaacaatcatctactgtccttctagaaaaatgacacaacaagttacaggtgaacttaggaaactgaatctatcctgtggaacataccatgcgggcatgagttttagcacaaggaaagacattcatcataggtttgtaagagatgaaattcaggtatgaggatcaatcatcattgctctccgttgctcatagtggaagtggatatttctcaaatgtttatttaccagatctttattgaatactttctttgtgttgaacataaagcagtccctctgataaatgtgggagaacaaacttgcagattagtataaatagcaatctgtacctagtgcttaggtgcacagaggagggaggaatagctctgtcaaggtagttgtgtaatgggggtggtccatccaggaaaattcaattagagtccaaacatgtaagtagaagtttttcaagtatgccaggccagtaggtgatgaggggaaaggaattggttatagaattccaggaagaaggactagcaggtgcaaagacactttgatatgagaacacatactgggttcaggaaatgtgactggtatggaatggttggagggaaagacaatgtggggtaggaatggcacaaagtatggacaaagaggcagggtggaaccgttagagacttgagagaacagttgaatgggtcggttggccaggttatagatggctttaaaacttgcaaagaagcagtctgggcttggtatcatatacctgttagttttcactgactactttagccttagaatttttagtttagatacaattttctgtaataggtaaaacggattaaagtagaataactctggctgaagttaatgtgagggaaaaggaggtacaagagtctcgtctctagaccttgaagacactccctgttggggtcttataatccttggagtgccgcagaatcatttgaaaaccatcttgatgtactactctgtgtttttaaataagataataggattatagaaacattagactggcagcaataagttggattgatttgaagaagagaaactgaagaagggaaagggtatcgatgcagctattgtgaaattctacagttgagattcctgacctgattggactggctcagtgggtgtcatagaggatttatttgggaggatttaagttcaaggcacatgagtaggtttaagtcaacaacttgacactgtcaacatgaaatccacactgtaactataagtccgaggaagagccctctcctgaagttaggaatttaacttcagctcttgcattttctgtcccaccggtcatccatttcttctctatccatctccttttctgatatctagttgttatcagtgttgttgaaaagcttaagtatgattcatattcactgtctataaagttcactacacatagtcatgctgtaatgcatacccgcctgaaagcatctggtctctcttttccttctttccaaagataagaataccattcacagctgtttagaatagaaattttatccaaattcttcagtgtttatatttttgttctgttatttcagtgtcttgaatattgtcaaatgacatttattagctactactggtactactgaatcttaataatcaatcttcaagccattaactgaccaatggtttcttctatcttaatgtattagtaattattcatttagagtaaaacatctcccagaacatgaaagaatacaaactttattcatgttacgttgtgacaggagactttgttggatgcgcctgattttcctgccaattcacagcttcattaaaacagtaatgctttgaaatatggcttaggaaacttcacaatgatcattaattacacctaatttctggaagagtatatgcatgtatgtgttgcggtattctcccttgctgtggcaggatgtcacaaatttttatccacattacgaaaatttaaaaattgatatggttttttctccctacgttgatatcagatattttgttttatctgacagctggcccaatgtactcctactttgccattataaagaattcaaaagcttcatatttgcattgaaagttctcaaacactttgtaaagatgatgaaagtatgtttcatcatctatgtagaatagtcaggtgttcttgcaattgattacttgctaccgagaattgaatacctactgagtgcataatgtatagaattctagatattcacttttgtgtgtttttacagttgttatataccttagtgtggctctaaaagtggaggtgacagctgtagctcttaatgtcttacactgagtgatgtttagaatcttaaattttcttttataattttagaaaaaagtatacttttctttcttatttttataaccagatccaaacacatttgcatgtagataggcatttttagtcttgaacattcatttttacttttaatcctcacttttattagtttcgtatctttttgtatttcatttcccctttcaagatgccttgagtcctttctttttaggaatgatgttgtgaataaattatttgataaaatgtctttacacctgagagtttataaggatagtttgaaaatcatgtctgtaaaataggttgatctcacctaaaaataataccatataattaaaattagaattattattgtgttgcttattgactcttacatatatcaaaaaattgctgagtcttattcagccagagcttttacttagtatgatattcattcctatatttacttttttctcacctttctcatactttcttttacttactcagcattttcctcctttcctccctcctttcttttcttctttccttcttttctcttcctttcgtattcctggtccatcttagcatgtaatctttctttatgaaatggcatgcagataggtctactgttcttacagtaaaaaacttcaaggcctcatgtctttcccacttctgtttcccattcacaacctttttagctgattcttttggtactttaccactatatcttgccatagtttatgtacctggctcctacttaattttttgtttatttgtgtattagtcgtaggcattatttatcgactcttctctctgaaagatgaaaggttagctctctttcacattcttaactgcccttttttcttaccttgtccatgtatttctaaccccctttcctcctaatatgtttatgtcataattttggctagattagtgtatacgatttacataattattactctgtaaatgctttttatgatctctgagccatgtagtatattatggctatttttctttcttatctatttgtatttttattgttattacctaaaaaaaaattttctatgtcttatcactaattcttccctaaaatttcccacaattgtgtaaacttacctcagtatattcatagatatgagacattctatcaattttaccctcttaaagatgcagagataatgcattatgtttcatcccaccatctttaatgagaagcttccatcttagattaatattagagaatgttaaaatactctgcaatcaggtaaggacgcttgaaacttcattataatgcaaaagttttctttaacacaataaatattttgaaccctttttgtgtcttgtattcataggagttcagatagaccactttatttactattttttatagagagtgaacagaaatcccatttctagtcaccagtccttaatctgtaaatcaggcagataatctgtaaatgattggttgaaatcacattgaattccactttgtgccagggacttaagttaacgaacaaattattcttacaaaaaggtataaatgtaaggttttcattctgctaaatatgtttgtcaaactgtgttgtgatttgttctcagtgtgtcatagctaccatagcttttggaatgggcattaataaagctgacattcgccaagtcattcattacggtgctcctaaggacatggaatcatattatcaggagattggtagagctggtcgtgatggacttcaaagttcttgtcacgtcctctgggctcctgcagacattaacttaaataggtaaaaaaaatttattgtttttactcttgcagatttctttctttctttccatataaacctcaaaagtgtttgaggctatttccagtatcccaagtaatttgtgagtgcatttaaagtaaaaaaaaaaaaaaagaaaaataaaacctccccaaatccagaggacatgtaagaagaacatttgtggtaagagttgccacttggagatgagctaatttcagcatgccttagttagtgtgaggaattaactaaatcaggacaatacttgggcctgtcacagagatcctatggaatactttcctaccattgtgcattaatgaacaggttcttttcctctcctcagatcctgtcaagttgcgatgtcttcagccatagttacttcaactaccactgattttgttactgattctttcttcccatgctacagtggtgattattccagaggatttctctcagtccctatttgactcttgttactatttgttttcttggttagttccatgagaccatgccagttctccttgactgtgtatgaatcattgtgttgcactgtactgacagactgccgtaagtcaatattaagtgttcagtatctaagtgcaggagaacctttctacttaagtactcaacaagtagtttgttggcacttaagttctatgagattttttgttgtaaaggaaaacattatcttgcaaagattttggggcagcatttaccaatactttgttccttcatccgtaggaaaaagaatctcaggagaaaaacctatacatggtaaccaatggggctgccaagctgatgaagtattttcagagtacacctttgtgtagctgaataaattgagatcttgaatggacatattagctcattttagtaaaatgataagagagtgcctcccactacagtttttgtttttatgcatcattaaacaatgtgtttttgattgtccactgtgttccatgaactatgctatgtgtgggagatatagtagtaaagaaaagcaaagtacctgcttccatagaattcagtataatgggaatggtaattctttagagaatcacataactatggatacataggcttcattttactgttctccttttgtgtttgaaaatgtcaacaatcaaaattttgtaaaaaaggaatcatgcaacatatttaaaattataactgtgttaagtgtaatgaagggaaattgcactgagtagtaagaatatataatggtgtgtggtatttcccaagttaaaaaggtcagataaggcttccttgtggaagtgatagttcaaatctgaaagaagaataggaattaattaggtaaaaatgtttgatgcaaattttaagattttccttctgagtagtcagtagcttttccttcttaacatagaagatgacaaaaccatcctttttttgtacataacaattcttgttttcctttagacagttgtatctgtcaagcttcttatgatctaatttaaataattgggatagaacacagctgtacatgttactattaaatatggaatatatcaaacataagttgattcctaccagttctgattttatttgtgtattttgttaaaggtactgaggacattaatatccagttttatattgtgcatttgaaggttcatcaataaatacaattcttgtttctctgggtcttaaaagatattttaaatggttatctcattaagatttaacaggaaataacagtgattcaaatcaaatagtggtgccagaaacccatacttgaattttgggtatagacaggttaccctttgcatcaatcctgaggaaactaaaactataggattaatcaggataaaaaagaattgagcaaggattcaggagggatctgtatcatcctggtgacaaccctcttctagaaaaaactagaaagtctaagaataaatgaagttgctggttctcacctggaaaggtcagttactcacaaaatttttagagtctatcttatgccataattctatcactgagagaagaaacttgtccagtcatcatgtaatcttcatgtaaatttatgtttttaattgcagaattcataccacaggcaaagtcccaatgtctgcatttgctgttaccttaaatagtcaaaccccaaagttattgtaatctttttttaacagagaataatttgcagagtaatctcggtccggtagatctttcagtggatccaaatgattgccatgaatggtttagaatttttttaattttcaagttgtttttattctgtggaatactggacttatttttgtagtcccaaaagaaaaataaatatttatttatttgccgttaagagttgtagttttgttttctcaaatttgtcctgacactgacgagattagttaaatgtaggtcatctgaaccaaatacaaggaaggaaggacccagttctgaagagtgtgggcatttcttttcttgtttttttttttttttttttttttttctataggaggggaacgaggtgaactaaacaaacaaaataaagcaaaaaagaactgatttttatcccttgaggtagaaagaatgagattacagtggacccccttgtctgcattttcactttctatgttttagttactcacaaccacgtccaaaatgttaaatagaaaattccagaaataaacaatttataaattttaaatcagtggtggctttgagtactgtaatgaaattttgtgccatcccactcagtcggcctcgacttcccttagaatcatccctttgtccggtgcattcacgttgtatttactccctgtctgttagtcacttgttgcagtatcacagtgcttgtgttcaagtaacgcttattttacttaagaatgaccccaaagcacaagagtactgtgcctaatttataaattaaactttttcataggtatatacatataggaaaaaacataatacatacaggatttggttggtactattctgcggcttcaggcatccactggacgtcttggaatgtatcccttgtggataaggaggaactgtatatggttaacctaggagctagagtcaacagttggaagagactttggggataattacatggaagggcatggtgggtggtcgtttcagatgacaagaatgtttttgaataacggatcatttgtgtcttcagactttccagaactccttgagaattatgcagaggtatttaatcagtcagaaggttgaatagtcaaattattagtgagtgaagtctattttgatgaggattttactaatgctgtcccttagatattataagtaaatcgttgttttcttttgaaatatctgaaacctagttaacatggactttcatttgttcttgtaaagatatgcaaagctatttgggagattgtcatcatctgatatttgatattcatgggctttcttcacagaagactagaaattaacagagtcatgatgaattatggctgcattgactttaaaaaacaaacacctccttaatgttatttaacaattttgaataaatttgatatggcaaacaaatcagttataatcgattgagaaaggaacttaattctaatacttgactggtgtcccataataacccataatactaagagacagttttggagggcgagaagtcctgaagagctgatagagataaaggttcaaatttgagcttctttcagtgttccttacgtcaatgcttttagtttctcatacaaaataaaataaagaataacctttttactgggaaaaggtaaaaattaataaattgtagaagcattgtttgaagccaaaaagtgtgtgacatgtaaattgaaatgaaaaaccttagagtttttgatactttttcaaagcagctaaagaattgatacttggacacaggaagaattttttttcaaaagcaatttttataaaatcagaaaaatgtttacctcttgttgggggcattgactggaaaggaatacaacagaactttctgagatgctagaaatgtttttttatcttgatggggtgtgggttttgtagataatgaaaaataaacagtaaaaaataagtaaaaaaaaaagtaagaaagttgccaatacagttttacatattcctgtgatgtttttaatcgacaggcaccttcttactgagatacgtaatgagaagtttcgattatacaaattaaagatgatggcaaagatggaaaaatatcttcattctagcagatgtaggagacagtatgtattatttattttatgccaatagtatggatttatggatgatgctcttttaagacaacaatttggctaaataattatcagtattttgaaaaaatattttgttgctgttacatgtgtgctgaatttttaaggctaacttctttgtgtctgagtaaactgaagtcaaataatgaagtcccaagtgaatcaattaatggtgattttacctcattattttcaggaatgaacttaacatatacgtttctgttcttttatttaatttaaaattttgtcttgggtagaatcatcttgtctcattttgaggacaaacaagtacaaaaagcctccttgggaattatgggaactgaaaaatgctgtgataattgcaggtccaggtaaagatttcttattatagatggacattctaaaagtctttctttctcttccttttcatgtttaactgaatttttgttgaatgataagtatttcagttttttaaacaaaacaatgaatgtgtttagatatgagaaagcaaacaatattaaagtattttgcttaaaaaatagataaagcaataaaatggtagccctaaatctaaacatatcaatagttatgttaaatgtaaatgatctaaaatattatttaaaggcgtaaattgtaagaattggtttaaaaacatgaccctgttctgtacgttgtccacaagaaatccactgtaattatatagataggtttaaaaaagaatgaaacattacattccatgaaaacattaatcaaaaggaagttggagttactttaatatcagacaatggacactttggagcaaagaatattatcaggataaagaaggatattatatgatgtaaaagaatcatttcaccaatgtatcagtcagggttcaccagagaaataggacgattgatattatggagatatatatatatatatatatatatatatatatggggagggaaaggaagaacaaatatggggagagagggatgaggcgactgattttgaagaattagctcacgaaattgtgggggttggcaagtctgaaatttgtagagcaggtcaataggctggaaactcaggcaagaggtgatgttgcagtcttgaggcagaatttcttctctagcaaacctagtttttgccctttagtcctgccactgagtggatgaggcccacccacattattgacaataatctcctttacttaaagtcaactgattataaatgttaatcacgtctacaaaatattttacagcaacatctagattagtgtttgaccaaacaactgagcatcataggctagccaagttgatgcataatattaatcatcacaaccaagaagacatcatcctaaatatatatatatatctacttaacaaaaagactgacagaactgaaaggagaaatagagaaatctacagttacatttggtgacttccagcatctctcaataatcaataaaactgacagaccaaaaaatcagtaagaagacagaagaaatgaacaggattatcagcatgctggatctcattgacctttttagaacattctacccaacaacagtagagtacacattcaagtgcagatgcagtattcatgaacatggatcatattcagagtcataaaacaaaccttaacaaatttaagaatcttgtatttgtatattttttgactagaatggaattaaactagaaaacaataacagaaagataacagaaaagtctctaaaccttagaaattaaataacacacttataaataaatccatgagtcaaagaggaagtctcaaggcaaatcagaaaatgttttgaactgaatgaaatgaaaatacaaaatgtgtgagatgcagctaatgcaatactgagaaggaaatttatagcattaaatacctatgtaataaaagaagaaaggtctcaaatcagtacctaagcttacatcttaagcaacaagcaaataagagcaaaataaatcaaaatgaagtaaacataaggaaataacaaagaacataagtcaatgaatagaaaagctatggtcataccactgctgtccagcctgggtgacagagtgagaccctatgtcaaaaaaatttaaaaacaaagcagcatgcagcattcattgtcagtgaatagaaaatgggaaaacaatagagaaaatcaactcaaaagctcattctgtataaagatcaacaaaattgatataaacttctaacaagactgacggaaagagaaaagacacagaagaccaataccaggaatgaaagagggaatttcactacagacctcccaggtattactagggatgataagggaacactatgaacaactcagaacataactttaataatttagatgaaatggatcaatttcttgataatctcaagctaattaaacttacagtgaattagataacctgcatagtgttacaaccattagagggattgaattctatgttaaaaatctctgaaaataaaatcccctagcccaaagaatttcaatgacaaattctaccaaacatttagaagacaaaataataccaattctatagcatgattccatttatataatagtctttgaaacataaaactatactagagggatgaagaaaagatcagtggttattagagattgggggagggagaaggtatgattccaaaggatagtacaaggcagtattttggagtgatagatttatcgtgccctgattgtgatgggagttagatgaatctatggatatcttaaaatgtgtagaactttacacatacatacaaccaatttgcctatgttaattgaaaaaataaaataaaaacaaattatttacctggtgggttagctacgtacctaagttcaatagctgcgttactgtaagacaaaagaagcattattagggatggagttgttctctgtgtaatgacaaatacttccttcactaagaagacagaattgttttatgcacctttaaaaaaaaacaaaaacaaaaaaaatacaaccaacaaacagtaacttgctggtgcggtggctcacacttgtagtattagcactttgggaggctgaggtgggaggatcacttgagaccaggatttttaagaccagtctgggcaaaaaaccgagactgtgtctctacaaaaataaaaaataaataaaaaaaattagctaggcatagcattatgtgcctctagtcccagctactctggaggctaaggtggaaagatcgcttgagcctggaaggttgagactgcagttgcagtgagccatgatggcaccactacactccaggctgggcatcagagtaagactctgtctcacataaaaaaaataataataatgataaaaactagtctgggcatggtggctcacacctgtagtcccagtcctttggaaggccgaggcaagagaattgcttgaacccaagactttgagaacagcctgggcaacatagcaagaccccatctctatttaaaaaaaaaaacaaacttaaaaatccagcaaatacataaagcacaaagccgacagaagaggtggagaaatcaacaaatccaccatcaaagtgggagaatttgatataattttaagttattggtagggtaaacaatccaaaaattagtacactgtagaaaatttggtcaacatagtaataagtttgcttattactatttatcagtatacatagtatactgatttatcagatacatagtatatggagccctagagcaagcaactatagcagtgtatctcaagtatttttacttcatgacccacatagcaaatgatatgtgtatataacacactgggctaattgtcagagttcagtttctgtccaaaaccctaagatctggagtgattaacctttcagcactcttagaactcacttgtttgtagcacactgattgagaagcactgaaagacttcactcctcaaacatacatggaatatttctaaaaactatgtattgggccgggtgcagtggctcatgcctgtaatcccagcactttgggaggccgaggcgggtggatcccgaggtcaggagatcgagaccatcctggctaacatgatgaaacgccgtctctactaaaaatacaaaaaattagccggatgtggtggcgagtgcctgtagtcccagctactcgggaggctgaggcaggagaatggtgtgaacccaggaggcggagcttgcagtgagccgagatcgcgccactgcactccagcctgggcaacagagcgagactctgtctcaaaaaaaaccaaccaactgaacaaacaaaaaaactaaaaaacaaaaacaaaaaaactatgtattagagcatgggttggcaaactatggcctgtaggccaaatctgcatgctgttttatttttttttatttttttgacatagggtcactacaggctgtcacacaggctggagagcagtggtatgatcatagctcactgtaacctcaaattcctgggctcaagcaattctcttgcctcacctcagcttcccaagtagctacaggcatgcactaccagacccagttaattaaaacaaatttttttttggtagagacagtctcagtatgttgcccaggctggttttcaaactccttgcctcaatcagtcctcctacttcagcctcctaaagtgctgggattataggcatgagccatcacgcttgactaatgtttttgtaaataaagttttctcagaacacagccatgccttttgtttatgtgttatgtagggctgcctgagttaagtagttggctacaaagcctatcatggcctataaagcctgaaatacttactatctggtcctttatagaaagtgttttctgaccctgtactagactagcttgtctcaaaattcttcaatgaatttggaagttttctcaccacattttctgaccataatgcacttgagttagaagtaaataagcagataaacaacaaaatcctcatgcatttggaaattaaaaataacacttaaataattcatattcaaagaaaaaatcaaactggaaattaaaaaaaattttaaacctacagataactacattaatatgcattaacatttttagaacttagggatagttacaatgatatacattaaaactggtaagaggctgggtgcgttggctcacgcctgtaatcccagcactttgggaggccgaggctgggggatcacgaggtcaagagattgaaaccatcctggccaacatggtgaaaccccgtctctactaaaaatacaaaaatcagctgggcgtggtggcacgcgcctgtagtcccagctacttgggaggctgaggcaggagaatcgcttgaacctgggaggcggaggttgccgtgagccgagattgggccactgcactccagcctggcgacagagcgacactcttgtctcaaaaaaaaaacaaaaaaaaaaacaaaaaaaaaaactagtaagagggcccagtggctcacacctgtcattctagctctttgggagactgaggagagaggatcagttgaggccaggattcaagaccagtctgggcaacataacgagaccgcatctctacaaaattttaataacaacaacaaaaaaactggtaagaggcaacattgaatagtactttgtgggagtttattagcttgaaatactcataatagaaaagaaaattaatcagctaagcatctcactaaagagattaggagaataaacctaagcatagtttttttcccccaaacattattatatctggaatattgaatgcattcttattgctatttcaaagatacttactctaaggaaagcaattgaattaggtagttgaactctatagtagattttctttaatgagtccttttgttctcaacctacttaaataattctcatttgaatttatgatagtttcagatctacccaaagggtgacttaggaatttaacttctaaatctatttaaatgaaaggtttataatctttttgtcatattttacagtcgttagcgtttaacaatttatagcataggatttgggtttttttttttttcattttaaagaagaagtttatttaagcaagacacttgactaagggaagactatcttggagttattattactagagtaatttatttctacttaaagacagattgccccacaagtaacagctacataaaaacagttgtaaaattgtccttggttttacaatgataaatgaaaaacattaaaattctctaattgaacaaggtatgcaaggatttttatattgttttttgctaaaactatgacagcaaaataacatcctggagtataaagataagagctgaatgagcaggccactaggggacaaagggagtcttttcacagaaccaatgcttcttttgcccaccccatctccatcgaagtcaatctaaacatattattggccatttagttaaaaaaagaaagaaaagaaaagcaatatgcttgtggacatacaccagttactttatgtgcaataaaagagtaggaaggggaaggtgaaagaatagagaaaactatgtagtcaggatgtggtggaaccaaattgcaactttcttttttttttttttttttttgagacagagttttgctcttgtcacccaggctggagtgtagtggtggcccaatcttggctcactgcaacctccgcctctcagattcaagccattctcctgcctcagccttctgagtagctgggattacaggtgcatgccaccatgcctggctaatttttgtatttttagtagagatgggttttcaccatgttggccaggctggtcttgaatgcctgacttcaagtgatccacccgcctcagcctcccaaagtgctgggattacaggcgtgagccactgcgcctggccaaattgtagctttctaattgagactgtcttcttggtctggaagagcagagttctgcagtaaaataacaggtcccccttttagtagacatctccatgtctgctgctggaacacatcagttttgtcttaagcctcacttccaaatgtgcagatgtgtctggttcattgattggctgcctgtcaaattgaaacctgatctgcctcattggcaaaccgtgccccttacaataggctttcattggtttactaagcggtgtggtgcgtggctgttcatcttaaactgcaccacagtttaagatgaaccttcaaatgaacattatccttgttctcagtcttgactttccttgggctttttgtggaccctggtgagtgtggcagtctcctcagctgctgcttcacaaaagaggtaccaggtctgccccgaatgagtgagcccctaaacaggaccaggagtggcagaagaaagaggcagcaactgagatgtgttttttctaagctgaaaggctttttttttttttttttgcaacacacctttaacactaaagtccaatatttatataattggtcaagtaagtggagctgttctagctataaatatggcaactctgcttgctcgtcctattattgacattattcctttctgtggtctgaggtgcctcccatgaaacttgcttctaggacactaggattgagaaccatcagcgtaacatatctgttacgctacaatagtttattttcatattttagctactttacatactcgggtataatgaactttattcatagcttctgaagcagttggcacatttgagatattttttacttggctaattgttatgctaaatcttttgatttctaaagatacatgcctttgctaagctttcttcaaatgttattatttttatttagattggatcattgctattccatggatgactcagaggatacatcctgggactttggtccacaagcatttaagcttttgtctgctgtggacatcttaggcgaaaaatttggaattgggcttccaattttatttctccgaggatctgtaagtatatatctgtgaattcccttcatagatcttcttttacttctattacacttttcttcagaggtttgcagtattatgattgtagctttgacttcagatgggtgactaggaactcatagagtcttactaagttccagttaaacactacattcattactttggataaaacccgtgtgtatggcatcttctgctgttttcatgttcaagccgatgttcagctctgcagctcagtctggaagcattgtgttaatttatcacattgcatttgggtgaatccctagactagtcttgcttaggataattaggaaaagttaactttcattgtatcaagggacaggtagaacaaaattgtccttttgtccaggaaactattaaattcttcaaggaaaactttagttatagggattattttttaaatgtctaatttcagtaacaatatttgggacatatttatttttccttctgtttcctatcagaagtatttaaagttataagaaaattgtggtttttgcctttactaatgaataaataatcaattaaattcagttacttttttttggagtgattgatgttccagtattcttctaaacaaccacgggtacaaatgtgaataagataggaccgttgcagtccaagagcttgttctgtagtcctttcctttatatgattttttcccctgatttagaagtctataaagcaaagctaagtattacacactgataatggctgaataaatcaagagcaagagataggatactttgcaaatatgcatatttattaaaaatgtactttaaaatagagattaaaattctcgtattgaatgtagaataggtaagcatttatttgtgaaatactcgaatgcttcatgtaaatactttctgagtttgtatttttagaaaggaacattttggaggctgaggcaggagaatggcgtgaacgtgggaggcggagcttgcagtgagctgagattgtgccactgcactccagcctgcgcgacagagcaagattctgtctcaataaaaaaaaaaaaagaaacatatttattaaattagttgtgaaatatttttaatgaaatatattgaaaacttctgttgatttttcatgtactgatgtttttagattctaaatggagtttaaaattttgtttgtaaatcacaagttggattagaaatttaatagtagaagtgttgcctaaggactattttaggtgctgtgagtgaaactgtattttttataacaagaattttagttgtaagggacagcttaaatataattgagatctgtgaaaatgtattctgtctctatcaccttcagaacctgtgtatctcagttgaatgtataatttataaaaattattcttgttttaatttggtgtaatccagccatatccagtatcaacaaataagtctaagtaggctccttgacaaacttgaactggccacaagagagatcagatttcacctattaaaaaaccaaatcagaccacttacactgacagtctcttctgggagtcctcaaattaagaagtctatcctttgtgaaatattacactacccttgctagataaaacttttctaaaagtaccacttaatgaaaatctgtagacactaaatgcaatgaaaataaggcattgtttttttttctccccatttcagtgatcttggtatcctgggatattgtttttaaaattatcgttataattcctttgagaatttagtgaaatgttccctttaaccaacttaggaaaaattaatatctttgtacatgattttgagctgtaaaataaacattttaaactgggaataattggagtttagttaaagagataatgtatataaatatataacatagtagcagcatataattctgtcttacacaagatttttctgaatagtataaacagttatgtagcctatctaggagtttgtgaatagagtttaaaattttgttttgaagctgcaaatttgattagaaattaaacagtgaagttattacttaaggaacttcgttttagctgtctgaacaacttactgtataaaaatctttaaacattctgtataaatatgtgataagatatgcaatgaccttaattttatagattagaaaataaaaacacactcattaatttacataactgacagattaagtgaaacttctcttctgatcacgttagcagaatgccaaatcttgtcgtggcactagaattagacggtagttttgataatacatgatttgactatagacatttgttgaaactattggtagttttaatcactcttgtaattttcaaactatctaacgggagaggattatccatcctgttttctagacaaactgtttcatctgaatgaaatatattcctagagataattatcactacttcatcttttggttttattttgcacatagaattatagttcacaatgactttctgaagctctaaagttgcagctgtgagcttctttggcctgtagggactgggaaaaagcacccccgtcctcccccaagcccccccaccaaaaaaagttaaagtgtttttaacaatagctgtgggctttttgtagtttcagaacttaggagttgcccaggctggaatgcagtggtgtgatcatagcttgatgcagccttgaactcctgggttcaagcaatcctcccacctcagcctccagagtagctgggaccacaggtgccaccccacccagctattttttttattttttaatttttttgtaggtatggggtctccccatgttgccctgcctgtctcaaactccagggctctcaggtgatacccaccacccttggcctcccaaagcaccgagagtcactgtgccaggctgagtttaaaatttcttgagttggagtttatggctattttttccactagttattaaacatgtatttttgtataaggcactgtattacattttgtggggggattcaaagctaaattagatgagacgcatcatctattatggaagatgttacttaagaagaaatgagtgtaatgtagcagagaattagataagggacgtatgaatacatataaatgctgttgaagttctgaagagagagagtgtttagagaaattagaggagtctttgtgaaggtatcactagaacttcctatttttgtggaatatatagtagattttggtgtgatactgtggatttggacattcactcagagaaggaatgagggaagaatggtggagaagaatggcattcacagtacaaaaagcaactgtgacttttaaagaagttaatatggagaagtggcaagtcttttcttctctcttctcttctcttctcttctctcttctttttcttttttctttttttctctgtcagataccgttgtaaagactttgcttttaccggaaactgatacgttgggtcatgtaccctggccagtcagttctctttattctaacacttagccgatcagttagatttccacattccatgatatgtcagttttggtgacccttatttttccacctggtttataaagggaaagaatgtgatatgtcacccaggctctggagtacagtggcatgatcataggtcacagcagcctcaaagtttccagttcaagcgatcctacctccttggcttcctgagtatgtggcactacaggtgcatgccaccatgcccagctaacttttttgtagagacagggtctccctatgtttcccaggctggtcttgaacccctgacctcaagtgatccgcccaccttggcttcccaagatattggcattacaggcatgagccactgtgccggcctgaaaatttctcttttgagatggcatcccacagaagtatacctgcttagagctaacactggtaaaaagactatttaaccctattgccttattttactgtagttgagattgagttaaactgaaagctgaatgacctgtcctaggtcatactgttactttgtgccagagtcaggatgagcaaatggatttcctgcctgctagtctagtgtcttttctatttattgtgctgtaacatacagttttaaatttgtatttttatgcccaatggacatggtagctcacacctgtaatttcagcacttttgggaagccgaggtggggggattgctcgagaccaggagttcaagatgagcctgggcaacatagcgagactccgtctctataaaaaaaaatttaaaaattagctgagtggtgatgtgtgtgcgtgtagtcctccttgtgggaggttgaggtgggaggatcgattgaatctaggaattcaggactgcagtgagccatgattacaccactgcactccagcctgggtgacagagcaataccctgtctcgaatgaatgaatgaatgaatgaatgaatgaatgaatgaatgcccaaatccgtaagctatgttctgtatagcagctttttcatcataggcagtttttactcttatcagtggacaacctacaaaattaactaaacacttaagcaattaacagaggaggccttgttcagagtgagaaatcattaagcatttgttgttgaaatttcttactgtactctgttttaattctgtttttttttttttttaatgttacttgttttagtttggattcctagttgaaaagggaatatgattcctttaaaacaaagatactctgctttaaagcaaaggtatatcatcctcttcatggtgattgccatggaaacaagacaatgtaaatttattcaaatagtacacagtttttatagttattgatcatgaggggaagggacagttaatccctactgatcagataaaacctcattgtttcatactaataaatggtttttttatgcttatgaaaggaaaagccagaagtgtaatttttagtgtttagagagctagtgattctagttagggaacttaatacctttgaagttattagtttgcaagcaatagaatctactactaccaaggtgacccctagcagatgtagagtaccattaacaagtgttccagggaaggaaagccaactagataccaagtcatgctttttactcttagattaagaaattcaggttgagttaaaggatcagctgttaactaataaaaagcagattaatattacagagccaggctctgtcctggttatggacttaatcttcacagcatcctcaagagataaaaatgaatatacctgcatattagatgaggaaatagaagataagtaacttgccagagctatgacgtgaactcaggtaatgtagcttaagagcccccacatgtatgtatattgggtgtgtgtgtggagggggtgcgtgtgagtgcttgtgcatgcgtgtggtataataagaaaaaattagcatttatgcctgtaatcccagcactttgggagaccgaggcacgaggatctctcaaccccaggagttcaagaccagtctaggcaacatagcgagaccctacctctacaaaaaaagttttaaaaatattagcgggcatggtggaatacacctgtagtctcagctgcttgggacgctgaggtgggaggatccttgagtccaggagattgaggctacagtgagctatgatgacacctctgcactccagcttgggtgacaaagagagaccctgtctccaaaaaaaaaaattagaactagttatctggaggcctgtgttctagtcctagctttagtacggctacacagtgacacattaggctaccatttaacatctttgaacctctgataatttgttaacaatatgggtaaaaatgactaagataaatcaaagagctccagcattccctccagctctgaaattctatgatgttttatcttattttacttacaaaaataaattatattatgtatatttaaagtatacaatttgatgttatgggttacctatagtaaaatgattactataatgaaactaattaacatatccatcatcttatattgttaaccatttttttgtttttgtggcaaaagcagctgaaatccactcatttagcaggaatcccaaatacagttcagttgtattaattgtaattctcatgttgtacattcgatctctagacttgtttatgctacatatgtttgacttttaaacattctactcaaatcaaccctaagtcagggttagcacagacaggacttgttaacaaggtagaaggtgccacattgtacctgggtgtttatatttctctaaatcttgttctgatcatattttaataaatataatcatcaggacaccaaaattcattccttagctattaaaaaattctattctattttattgttaagatttaggagagcatggtacagattctcttaactatacctatcagaagcctatgttttaagtccaatgtataggcactgctctgtttgtctctggtgggaacttaccctgctttacctaatttcatcctagcttcctttttgtgaaagatcacccttgcttagcctattttttggcaaatctacaccttggaaatagtagtaaatgacataagcatattaatatttatgatgtgatttatttttgttttcaagtcatatactggggaagattctcaaatattaaaacaatgtatctttacatttatgtatgtcgttcttgttctgttttagaaggcttgtatttgcatttttaacattccaaaaggtaaacctgtaatcataatgttttcatcaattcaataaaaccattacgtttgtaatagagagccctatagttgccttagttaagtttgctgcaactcattttatatattcttttaattttgatccctggatttttaattgattattaaaccttcattaggatatatatgaaatgtaaaaatattgagttataatctaccgttttctaaaattttatactgcatttttatatagaaattcaaattgctcataatcattctagtgaatttaagtagaaaggtatttattactaggtattaaatggcttataatattgttgacaaggttccactgcaaaatagttcaccaagggagctgtggcctcttctgtgatcaagaagccatctgtcaacttgggaagcttccactatagcacctaaccccagactacattgagtaggaagctgtaataatcaggaagcttctacctttgcatgctctgcaaaccaacgtgaacctgctgtaatttgtaaccacaaaatggatgcctgttgatacttacgaagctcatcattgtatgctgggttctttgctaatactttcttataaaaattaaatacctccacaatcatgcatgctagcagaaacagcagacgagtagccttagcctcacttcctgcttatacctgtcatgcaaatatacagaacccagaaccctagctgaaagggagtttgagaactagtatttgtattgtcccagattctgcagtggaagaattcatagtggatggaagttagaatgacccttgaattacaatcggccacattcatcacaaatacattaaataagagtaatttgccataaagctctatgtttgtatacttctttgttttttttttttttttttttttttttttttgagacagggtctcactctgttgctcagtctgtagtgcagtggtgtcatcatagctcactgcagtcttgatctcctgagctcaaacgattctcctgcctcagctcctgcttcagcctcctgagtagcggaacaacaggtacacaccaccacactttgctaattttttattttttattttttgtagagatgtgggtctcactgtgttgcccaggatggtctcgaactcctgggcttaagtgatcctcccaaagtgttgggattacaggcatgaaccactgtgcctggcccatatactacatatatttaaaagtagtatttaaatgtgtaggatgaatgaaagaggcagtaagagaacaaagtgaatgaaaaagtatttctatatgaagtgaaagcaggagagtcctctctgttagagaacaacagaattgcatatgacagactagctttcttaatatttctagaacttgatggctgtgaagagcgtcccgtaggaattctcccttcacttaggaaaacatacctcaaaaccatcagctgtttagcatgcacctgcttttcctggtatatctcagtgaagcagctaaattgtaaatgattaagtaaactttgcagtgtatcatgtgcaaaagcacagtaaaaacaaaaatgcattggaagctgtgagttgttgcactgcactcatggatgaatagctgttggttcgcattgcgtttttttgttttgttttgttttgtttttttgagatggagtcttgctctgttgcccaggctggagtgcagtggcgtgatctcggctcactgcaagctctgcctcccagattcacgccatcctcctgcctcagcctcccgagcagctgggaccacaggtgcccgccacaacacctggctaattttttgtatttttagtagagacggggtttcaccatgttagccatgatggtctcaatctcctgacctcgtgatctgcctgccttggcctcccaaagtgctaggattacaggcatgccgcattgcgttttatataattctcatggttctagtctcgagctgtaggattttgatcactgtttcaaacaataatgtgagtttgctaagaggtctaaataacaaaagctaagtgttccaaacacatatccaaacctatacactgggcaatgcatctgaattatatgtgaaatttcctgccattatttaagacacaaaaggaacattattttgataatgtatttatttgtgagtggagtgttcagaatgagcacgatgggtataacatttttgtaggtttttaaagttgaaatttagtgtaaatccaaagaatcaatagacaagtctgtgttttacttaacctatatgtttaaattagcatttttagatactgattttattcctaatttcagaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaaggtaaacggtgtaggagtctgcctgtttgacttaattttgtttcccactccacattaaaagatcctttttgcttttaatagggtagaaattggcttcataaagctaatacagaatctcagagcctcatccttcaagctaatgaagaattgtgtccaaagaagttgcttctgcctaggttcatttttcagtttttttcttgtaacttctgcattttttgttgctatttatgtgattcaaattataccagtttataggcctctcacaagtaaaatgaattacctgtttgtttttgtatgcctattttagtcagtttgggggaagggatctgtgaggaaaggataagtcatagagcacttttcttttttaagagacagagtctctctgtgttgctcaagctggagtgcagtggtgcgatcatagcttactgcagcctcgatctcgtgggcccaagtaatcctcagccacctgagtagatgggactacagacatgcactactatgcccagctaatatattttaattttttgtatagagacagggtcttctagtgcttcctaggctggtcttgaactcctgagctcaagtgatcctcctgcctcagcctcccaaactactgggattacaggcatgatccaccgctcccagccagaacattttcttggttgatgggaagtagctgaccatggtatttagaaaacttctttctcatcgattaaagaagcagtactgaaatcaatgcggaggaatccatatatcatatttacttctggtgtgtagaagtggaaagggaatacatttgttgcttacttttttgtacctttacatgtgattgatcacttgtgagttttttctttcaaacatcttaaagcttccagagctttttctagaaaaaaaaaccagttttaagaatcaccagttctaaaagggtaatatcttattcatctttctgagaatggagtatcatgattcatgaattagatacttgcatcttaacatttgaaataatttaattttattattttttagttcgaaaactgtatcttcgggcaccaaagagcattgttataatcaagtaccagttgaattaagtacagagaagaaggtttgttttaaagaaattgttctgatttatttcattctttattgattcaaattctgtttaaaattttatattttaattcctttccaattaaagagaaaatggcatatataacaaagcataaaattcggccagggaagtgatgtgaacagactaaaatttattgtatataatttctggggctaataaagaattggaggtatttgagaaaggaattaatttgggttcttttaaacctatctgctaactcatttggcttagagtagtcacatgttataatacttatagttgatcaaaaaattgattcctaagtgttcttattaaagacacacacacacacacacacacacacacacattctctctctctctctctctcacacacacacacatgcacacacacttatgtactttcttgctttttttgacctaagatcttagataactattacagattaaatactaatccactggcagacttcagctaattagaacactggaataataggcaagcatagtgaattacattttctggtgaactttttctgctttattgaagtatgcagaatgtaaatgaattgtttttataactttggcacttgctgtatcttagaacattcttttgatgatttattttctgtagttttgggagagataagacattggaatgcgtttctaactacctttagaactttagaaactgataatttaggaggttattttcaggtgattaatttgacagcttgattaggcaaagaaaaaattgtgattttgagatttttgtttcttattttcttcacatttaaaagttttttgaaactttttttaatggacctttatatgtttaaatgcagtctaacttggagaagttatattcttataaaccatgtgataagatttcttctgggagtaacatttctaaaaaaaggtacagagttccatatttctatgttctatacttgctttatgagtacttttttttctaaagagaaagaactgtcagatgttgggctatttcattggcaaaaggaagttaaatttaaaacataagcttttcagtattagaatgatcaaagtgagctataaaagaataatgttaatttaatagctaacacttcttggatattactgtttgtcaggcattatgttaaatgctaagaactttatatgtgatatctcatttaattcttacaagagtctaacagctgttactatttatcgccattttatagttgaagataccaagggttaagaagttgacaaacttgttcaagagcatacagctaatggccgagctggctttcaagtctatatttgtctacctctagcatcaagacactatttatttttctttgtatgaaatatatacaggcatactttgttttattgtgcctggctttattgtgacttgcagatattgcatttcttataaattgaaggtttgtggcaaccctgcgtcaaacaggtcatattagccccattttccaatagcatgttctgttgtcatgtctttgtgttatattttggtagttcttgactggccattcaccatttctctccctctcctcgggtctccctgttccctgagatacaacaaaattgaaattaggccaattaataactctataatagtctctaagtgtgttttttttttttttcgagactgagtctcactctgttgttcaggctggagtgcagtagcacaatctcggctcactgcaatcttcgcctcccgggttcaagcgattctcctgtcttagcctcctgagtagctgggactacaggcgccccccgatcatgtctggctaatttttgtatttttagtagagatgggtttttgccgtgttggtcaggtggatcttgaactcctgaactcaggtgatccgcctgccttggcctcccaaagtgctgggattacaggtgtgagccgctgtgcctggcccatctctaagtgtttaagagaaaggaagattcacatgtctctcaatttaaatcaaaagctaaaagtgattaggcttagtgaggaagccatgtcgaaagctgagataggccaaaagctaggccccttgcaccaaacagttagtttgcaaaggcaaaagttcctgaaggaaattaaaaatgctaccccagtgaataaaacaatgataagaaagcaaagcaggctttttgctgatatggagaaagttttagtggtctttataggagattaaaccagccacaacattcccttgagccaaagcctaatccagagcaaagccctaactctcttcaattctctgaaagctgagagaggtgaggaagctgcagaataaaagtttgaggccagcagaggttggttcatgaggtttaaggaaagaagccatctccataacataaaagtgcaaagtgaaacagcaagtgctggtatagaagctgtagcaagttatccagaagatctagctaagatcatcgatgaaggtgcctgcactaacagactttgaatgtagaccaaatgctttctaccagaagaagaagctgtctagtactttcatagctagagagaagtcaatgcctggcttcaaagcttcaaaggacaagctgactctcttgttagaagctgatgcagctggtgactttaagttgaagccagtgctcaattagcattctgaaaatcctagggcccttaagaattatgctatatctactctgcctttgctacatacatgtaacaacaaagtcttgatgatacctgtttacagcatggtttcctgaatactttaagcccattgttgaaacctgcttagacaaaagattcctttcaaaatgttattgctcattgacaacacttagtcaccaagagccgtaatggagacatacaaggagactaacgttgttttcatgcctgctcgcttaacatccattctgtagctcatggatcaagaagtaaattaaccttttaagtattattatttaagaaatacagtttgtaatgctttagcttctgtagatagtgattatcagagatgggtttttaagaggttttccagaaaaccttctggaaaatattcactattctagaagtcatgaagaatatttgtgattcaggagagtaggtcagaatatcaatattaataggaatttggaagaagtcgattcttattaaaatcaagagtttagtgatagacatactgagtttgggatacctgtggagtagtccagaagttaatttaaatatatgggcttagtgtacagaagtgagcagggtgcttatatatgaataaatattattttaagatatatttaaattttccttaaaataatacctatacttgatataaaaagttaattggaaattagtggcttatgacaagcataccagcccacactcttcccaaacccactttgctcttattcatagaagctgtcatcttcaaatcttccagctgatttccctggcgtgtgccttcttatttctgaatgacacgcttagagtactatttttttgacttagcaattttagaaattttctactcatctcctattatggtagatttcccctccttcattcctcctccaatataattatatttcgtcatattaataatttgtttatatatatttttaatataatatgataatattgtatttatattattaaaactacacaaatattatatacacactactaacccaaccgtgttattatggccaccactacctttatttttttccttgtgttagtgattgtctttgttttattttcttggttttgagtattccttttactaattttcttttttcctatttcaatctctcattatttgtttactcatttggagtgttccttgacttttatcccctcttacctagtgacattttaattttagttatcaaatttttaatttctaagaatgcttcttgttctcttcttgtttcttcttccccaccagccaaaaatctatgatgttatagcaaggatcatacattgtttcccagtaggttaagaaaccttggttaaaacctgttgtatcccagtaagttaaaagacgttaacgtgtcatcttcagtatggatgaaagaatattttctttcaaaagcagttggttgaggaagagaatgggacaaatgctctttttaaaacaccaattttgtgatgaactcaaattgcaattttaactttaccattataatgaatgtatttgatccaaaatgtttaaaatctaggctgttgtcatttaaataacaaattaccttactggtatcatgaagaataaatgtttgtactgatttggaaagacattctcatttaggggatgaaatagaaagtcaatgaggagaaagaaaagcttttattatttattttcttttaaatattttagtatcatggtacagtcaccagaaaaagcttacagttcctcacagcctgttatttcggcacaagagcaggagactcaggtaaggcttttgtaaaaaggtaattagtttatgataggatagttatgattctatgtatgcttaaaattctgtattttgccagcattttaaaaattgttcttaagctaagagtctgagtttatatttcagtttatattcattctaaggaaaaatgtggtatctgaagctctaaaaataaaggactagatcttttaagtacactttaaaaagtgttgtttctttgttttttgttcagattgtgttatatggcaaattggtagaagctaggcagaaacatgccaataaaatggatgttcccccagctattctggcaacaaacaagatactggtggatatggccaaaatgaggtaaactatcttttgcatgtgttctcatttatttccttctaacaaaatagatttggaaaatatatctaagttgataatatgaccatagcttccactgtcacatctgggaggtgactcagattccccctgctgcgatgcttatctctttgccaagctttagtaccgtgtttctgtatgaataaaaaccagttacgttttcagcaatcatattcaatatttataaaatctaactcattatttacccaccctgcattttatccaaatgccgaaactcctctttttggattctttatttttgattatcttaccatcacatttgtagtcagaggttcctaatgcttaaaacctctgatctgaattttctctcctccaatataaaaccccttcgtcttcctcttcttcttcttcatttttttttttttttttgtctgaagacttgtctcactgtgttgcccaggctggagtgtagtggtgcgatcactgctcactgcagccttgaccccctggactcaagctatcctcgcacctcagcctcccgagtagctgggactacagaacatgccaccatgctcagctaatttttgtattttttgtagagacagggttttgccatattgcctaggctggtcttgaactcctaagctcaagcaatcttcccgcctcagtctccaaagttctggcactacaggtgtgagccactgtgcctggcctctttttctcatttaaatacttttcataccttttgtaaaacgggttccttgttgcctgtctatgccttcctcctccttcttaatgacaccacgttaattctgactgttttcccttggcctgttgcagaagcctcttaactattaacccttcattctctctctctgtttcatctgatatatgagtaccaaactaaatcttcctttatcatatcttacttctgcttaaatgttttttttctagcttagaattcaaggccctctatttatgaacttaaacttacttttccctctaagttacagaatttgaaatggtttatcttacctggattgtttatcacttgttgaagatccattttcaacttccatatatttatttacagtgttgcttctccttgtagtttccttgattcctcaaaactccttttaagaattcttgaagatctcgctttattactatttctcgctttattactgtaaagactatgagaaggtctttcatgatcttatcagcaaagtaattcctctctcttgaattcatagaggactttcagatgaattctaaagatgcttctgtagcacttaccacacaatgctatattttatttttttgtaattagtggtaaacaagtattattatatcttctagattttaaactccaaataaagatactagctccttacctttttgtgtgtctcctgtagcacctagcacaatgcctcataaacaggaggtgatcattaaatatttagaagaaattatttcccaagaatagttgcttggtaattgtatttgtcttttacttccttttaaaaaattgtttctgtcactaaattgcatccaatagatgttacttgagtgcagaattttctaatgacattacacagtgctacatctgacactaattcttttgttaaaaaataaatattctggccgggcgctgtggctcacgcttgtaaatcccaggactttgggaggccgaggcgggcggatcacgaggttaggagatcgaggccatcctggctaacacggtgaaaccccgtttctactaaaaatacaaaaaattagccgggcgtggtggcgggtgcctgtagtcccagttactctggcggctgaggcaggagaatggcgtgaacccgggaggcggagcttgcagtgagcggagatcgcgccactgcactccagcctgggtgacagagcnnnnnnnnnnnnnnnnnnnnggaatagctgggactacaggtgcgcgctgccacccccggctaattttttgtattttagtagagatgaggtttcactgtgttgtccaggctggtgttgaactcctgagctcaggcaatccacccgccccggcctcccaaattgttgggattacaggcgtgagccacagtgcctggcccagaggagatatttaatgaaaaataataatcattagataggcagatttttagaaggagggcatcgaatgggttcttggatattggacacaataagaaatattgagctaaaagtctgaaggaattggcagatatactgttacaggtaaacactttgtagaagaaaataatgaatgagactttcttttgagattttcttagcctcttagttgttcccagttaaagcctcatatttttccttttcatgacaataaaaataataataaaatcagtaataaagtgaatatatgagatgttaacctgttcctttatgacaatgtcctgtttaccaattaacagtgtgtttttgtggtgatgggggcaagacaaatctttaaatggtggaaagcaaagaaagaaattataaaacatgattagttgtattatacgttgtttttggttgttggaaaaactatacatttattgagagaatcattaggaagctgaacatcagctatattgctggagtgatactgtttcagtggtttcttgacctttttgttgttgttgttgttgttgttaaacacagaccaactacggttgaaaacgtaaaaaggattgatggtgtttctgaaggcaaagctgccatgttggcccctctgttggaagtcatcaaacatttctgccaaacaaatagtgttcaggtaaaatactgtggtttgcaggagctcttagagaataagcattttttgtaaccatttcaaaagtaccctccagaagcaacatttgctcactttatttgcatttccatactggacacttagaaaatgaattaaaattgtttttacagtcaatctgttgtaaaaacatgtcagttatctacttttaaagatgatactaaaaagtagttgtccaggctgctgatgtctttctatttcattgggaggttttgtttttaaattggaaacattattttaggttgataaattataattttacattcaaatgtggtagttggaatttaaagctggaaagttatccttgctatgagttggtcaggagctcagccactttcttttggtttagcatcttctctaatctccctccccttccagtaatgctgtcttttgatagtaagtggatttcatattattctcttcagttttaatagtgtttccttcatatccttttattattgcttgttctgccctaagtgaccatttccagaaatgtcatttaggattttctctaaactccacgtagcagactctataatgcatactctgcagaaggtgaggcagtgggaggtagaggggagactactagactaggagtcacggaatcaggactttagttcttccttacagttgttcacctggtgaacctgcacatgtcctttaatttccttgggtctccatttcctcagctatacaatggaaatgacacttcctcccccacatccaggaaacaacagatgacattagaaaatagaagacatgggataagtataaaatgttgaaagagttaaacacattcaaggcaatattaagggattattttttacttccaagaagctcctggaagctttgggcaggcacagttggatcctactttagaaaaatctttctctaactataagtagaaaacccttctgctttttgaatgtagcatttccctcttttgatatagagtatctttggcaactttgaattttctttttcatactcttatataagacatcatgtgaaaattcttatttcttactgagtttttggaaatgaaattataatgtcttaatagtttgagaaagaatatcatacctaccagcggtaattgagtaagttccctctctttggacacttgaaagtagtatcttctttcatgaattagtgatattatttaataatgaatgagtgatctctcctaactccccttcagaagaggaaaatgaagtaggggaaaaggtaaattccccaagggataggtatgaaacctttatgaaccttctggatagagaagatgactgctgatttctgtgattagaaattatacttgggttattctgcaaattgaaatgaattatttaaaaaaaaacaactttaatgtttattaagcaagttttgttattcatgagtttcattagccttttattttttttttaaattttgaagtaaaatttcttgctgtcacaatacacattaaaaattacaaatatgacacatattaaacacattaagatggccgaataggaaaaatatgctaaaatatttttatataaatacattttttgagaattttgagaatttctggaacaaagtaatgatataatccataaatgtacaattaaagagtttaaggatatccaaaatacttggcaaagtaatctgaaataatactcttaggaaggtagggcaagaatgtgattctagtaagcaaaaatgtaatcaaatcgtattctagtcccagctactcgggaggctgaggcaggagaatggcgtgaacctgggaggcggagcttggagtaagccgagatcgtgccactgcactccagcctgggcgacagagcgagactccatctcaaaaaaaaaaaaagactatatgaacttgtatggcataaatatgtacaaatattatttattttaaaaaaattcaggggtagggacagggtagttagaaaatatctaaggatgttcatgaaataatactggctatgaatgacagttgatgaaaccgggtggtgcccatcttattccctcgactcgtgtatatgtttgatatatcccacaataaaccttaaaaaaaaaaagatgagtggtcaattataggaagatataaatagaaaaggcaataaggacaaaagttggcaaagcttacctaagcactcttcagataaaaagacatttttgctaactagatttgaatattatagtttaattgtcaaggaaaatgcctcaacttaatctttgttaagagactacttaaggcactatcagaagttccctcatggcaaggtgcaatccctcatgcctgtaatcccagcactttgggaggccaaggcaggcaggttacctgaggccaggagttagaaaacaacctgggaaacatagtgagacccgacctctacaaaaacaatttcttaaaattagccaggcatggtggtgctagcctgtaatcccagctatttaggatgcttaggcaggaggattgcttgaacccggggatttgaggctgcagtgagccatcattgtgccacaatactccagcctgagtgatagaaaaaaaaaaaaaaagtgtctttgttatattccaaacttgttctcaactttcaggtgagctggcttcctgtataactcttgtataggacagaacatactggttggggcaagtgaaactgtctagttgtatgcctcataaattaatgaatttcctttctaatatatacactgatatttatacacacatacacataaaaccaagctcaatagatgggtagtgcagctctattccccaaaacccaactaccctgtaacaagacacattagacttttgagattgcaaggatgaggactgaaatgctggcctagaccatggtgttgccatagtggggtgaccagtctgaatagccaacaatgcttcctcagtaaatacccattttgtcttggtgggatttctacaaattgcaaaatgcagctattatgaagctgtaaaagagaaacagaaacatgtaacacctgggactgttttattaggcccaccgtatgctcagaacatgaaatctccactgctagggttatttgattgaaattatcttttgtgttgatgtgagagtttagctctgagattcttccacatgtaaaatgtaatcccccaaagtatttggcaagcacattttattgccttgggtcagataattgaaacattaggcatcatatatatagcatgtaaaaagtaaaacagaaacatttatgtttctcaccaagcagtaaattagtactcaactaataaatttcttaaactccctaataacagaatatggaaacaaaaaataaatctttccaaaagaagagctcatggacacatttcctcatatatgtatacataatatagtagaacacatgataaataacctataaaaatgataccaatatcattcatcaagagacgaggctcttctttaaattattaatttcatctgttacaggttttattatgactgtagtatgctgttttcatctaccttttatgtgtagttaaaaaaatagttttctatctctttacctttatttcagcctttaaaaagattccattattttttcattaatcttgtttttcagtttttcccattttttcttttaaacatttcttaaggaaccatatttaagattttatagaatacttagatttctagttgggatgtatcatttaaaattagatatgtagagagagtgttatgatatatttccttacgatatattagtggttatagtacctaaatttgaatagtgattctgttcattcattcattcattcattcaatattcacttccaggagattggggacttatttaaagacagagtagttcacattatagttcctttttttagtccttcttattcgttaaagaaaagactaggaaatgtttgttattacaaatattttattaaaattttgtgtgctctagcattattttaccttttaaaatcaatatgttaaaaatccaacttctttttgagctccccataaaaagggaattatttgttgcttatgggtttaacttgtgttatttttttcttaatggctaattatcatacatatattctattattgtattgatattactgatcatttgtgctacattaaaaattctgtagacagacctcttttcaagtacaaaacctcaagaagaacagaagacgagtctggtagcaaaaaataaaatatgcacactttcacagtctatggccatcacatactctttattccaagaaaagaagatgcctttggtaagtgtgactttcatgttacagggaatttttttagtttacttaaacttgtgttttatcagctttttagtattaaagttctgacttgggatcaatttcctccaaccctacaataaatctcagtttatctttaattttaaaagagaatgttgttttctttttctgttaagcctccctgttaagtaatagcagcaagtttagtttggccatgaatatcttctagagattgtatcggggtactgataaacacatttatagctcagggatactgcatcagccatattttaaaatgggactaacagtttaaaaactataaatattcacagtgttaagaaacaatctcaagatgcattaagaaaaaggaaggtgcaaaacagaaaaacaaacgtaaacgtgtgtgcatatgcatgcttatatagtcacatattcttgtatgtgtacaaaaaatacacactggatctctgcaagcatagccaagcaactggaaatatgtttttaaaaacttgcttttcattctatctcttctagtactgttttgatgctctttgaaaacaatctaattgctgtaacaaatgaccatacgtaggccgggtgtggtggctcatgcctgtaatcccagcacttcgggaggctgaggcaggcagatcatttgaggccagggatttgagaccagttggacaacatagggagaccctgtctttactaaaaatacaaaaattagctgggcgtagtgacgcatgcctgtaatcccagatacttgggaggcggagacatgggacttgcatgaacccaggaggcagaggttgcagtgagctgagattgcgacactgcattccaacctgggcgaccgagcaagacgcggtctccaaaaaaaaaaaaaaaaaagaccatatgtaatgtttcttcattgttctaagataaatctttaaggctgttgaggttttttgtatacaaaatggagagtaagttttaatgggatgggacaaaatgaggcttacagttgagtttaatttgagttcacatcctgttgacattaagttgatttggaacaagtgatatggtccaatgcctgcttttctattgtctgtggttccatccactagtgcctgtgttacacacctcttgttcaggttttatcatttaaaataaataagaataaacagtccatagcttatcttacttactgaataaatgctctaatttgacagtcatgtttcttaaagttccttacaaaggccattgcccaagaaaccaaataattccattatactatttttgaaatagaacacataataaatgggaattttaagttcagtttcttatgtaaacaataacttctatgtacatgttaaatatgcctgtatatacctaatttgaccatgtatgtatagtagaaatgaaaacagttactaagaaaatttgttattggctccaaattttctgaattaagtgtattctaatgctcagccataatatggggtttcatgtgttagtttatgtattcatggttaaaaatgtgaagactgttatatcttcatttgtgtcttttggtattatttggttgtattttattgtgtgatatggtggtataattatccttacctcccaggagtttgagagggtcttgccagttaaccgcagaattaaacatgcctaggactaattaatcaggagcaatactacaattaattggaggtaatttgaaacctggtttcaaataaccctgatattatgcacacatggtgcacacttttctagtagacatttaatgaaagtaatttaaaacctacctttgaaggatgaaaaacattgccttaaatgctctattctgtgaaagtatcaacatttatgcaaatacagtctaaattcagactttgaaaatgtattgaaagagaggatcatgaaataagttagagctgagtgacaaagctttctgagtgtttaaaagaatgttttacctaataaatatctgaaatgtatttggagccacatttgtttaaagaactgtataaatatgtagcactgttcatgtgaagttcaatagtaggaaaatgctgacagcccttgtggaactgtggttattattattttatgaatagagccaatttcaaacacctattagagtcttctcaggaacattttatagaatgcatctggagccttatgttatctctaagcattttaggatttgtcttcttggaaattcatgtaaccaaaccaccatgtgttatttcaagtgtatatagtattgggttacagtttactatgttttcagaaggttgtgacaactattagacttacagagaatgacttctctgccactaacggctttctaaagtgaatagagaggggcgaggattgaattcttcggtaaagctgggtgattttgttttattcaatacagtataataagtataaaaagtagaacctatagagagctataatgggggtagttttaaagaaattctgaaaatgaaaaacttaagtaaaggtttagttcattgtttatttcacactgagcatttactacctgaatgttttggacattttatttccatgactggagtggacacttttacaactcactgggttctttgctgatctttctctagaagagcatagctgagagcaggattctgcctctcatgacaattggcatgcacttatcccaagcggtgaaagctggctgcccccttgatttggagcgagcaggcctgactccagaggttcagaagattattgctgatgttatccgaaaccctcccgtcaactcaggtgagaggcatggcctagctctgcacccttaatgacttgatgaagtaaacaagcaatccactatatttttcactgttaacagcattaatcctttatgctattatgaaaaccttacttttgtgattctttttcttgttttaggaaaacaatctttcttcccattatcactcagaggaaagtatactgagaaatttttttgttttgttttgttttttgagacagagtcttgctctcttgtctaggctggagtgcagtggcgtgatcttggctcgctgcaacctctatctcccaggttcaagtgattctcttgcctcagcttcctgagtagctgggactacaggcgtgtgccaccatgcccagctattttttgtattttttgatagagacagggttttccatgttggctaggcaggtctcgaactcctgacctctgatgatccgcccacctcagcctcccaaagtgctgcgattacaggtgtgagccatggcacctggccaatacactgagaaatttttattttccttttcagcttaaggttacaacttccccaccatccaaaacgtgcactttcattttttttctaatttctatctcatcacttgcaaaaaccatatttttctccacattcattcccagtagcttcctgactcctagttcttccctaaatccttctgagtccttgtcattggtttcgcttgagtagcctttctaatcaacacagtcattggtatcagttactgtgacatggaagggacagaccaagttctgtgggccgctacgtagaaggatttcctgtcactttgctgcagaacctcagctcgcggagagcaagcccctttgcttgccctgtagaaatattttaaattattatcctttttttttttaacagaagtaaataggagatacgttagaggattttctctcctagatgtgtaaatacaaacttggggtcttataactcaataaatctgataaatttcttttgactgttaggatagagcagtggccataccaatagcctcatctccaaagctgcagtgaagatactttttactaccttaaagtctttcccatttgtgaacaacttgtgaacaattccccccaagaatttggaagatcactctctgaaagcacagtcaatactgtacttaaatggatctgagcaaaaataagtcacttagaagacaggattatttctagacttgagtgtgacttgactgaaggtctaaagaacaaacagctccttcacttccattgatcacggtggaagcacagggaaaggacagacacggaggcaagttggagtagtgctcatctaagttccagggatgcgggggagtggccaggggacttcaggtatagtaaataaataacctatttataagttatgtcaatgtcatgtttgaaatagaaaaccaaatactgcatgttcttacttacaagcaggagctaaagttggtgcatatggatataaaaatgagaacaggccgggcgtggtggcttgtgtctgtaatcccagcactttgggagacctagatggaaggattgcttgagctcaggagttcaagaccagcctgagcaacatagtgtgacccccatctctacaaaaaataagaaaattagccagacgtggtggcatatacctatagtctcagctacttgggagtctgagtcaggaggagtgcttgagctcaggagtttggggttataataagctgtgatcatgccactgtgctccagcctgagtgacacccagagtgagaacctgtctcaaaaggagaaaaaaaaaaaagtaacagtagacgctgggaactactgaggggagggaaggaacaatggttgaaaaggtgggaagggacagtggttgaaaaactacgtgttgggtactatgctcactatctgggtgatgggatcaattgtacctcaaacctcagcatcctgcaatatactaatgttacaaacctgcccatgtactacctgaatctaaagtaaaagttataatttaaaaaaattataataaaatcagaaaataaaggtctgagatggaaaattaaaagaccaaagccacccataagcacaataaatccctccccccaaaaaattatatctattaaaaaaaggtgttgcgccaggcactgtggctcatgcctataatcctagcactttgggaggccaagacgggcagatgacttgacttgaggtcaggagttcaagaccagcctggccaacatggtgaaaccctgtctctactgaaaatacaaaaattagccagcagtggtggcatgcgcctgtaatcccagctactcaggagactgaggcaggagaatcgcttgaactggggaggcggaggttgcagtgagccgagatcatgccactgcacttcagcctgggtgacagagtgagactctgtctcaaaaaaaaaaaaaaaaaaagaccttgtaccctgacaagttttagtttgtgcaggaatgacacaatctagaatgactcaagattggaaaaatctttaaatgttaattacacaataagggtaaaaggagaaaaattacctaatgtcatctgagcaacaagaagaagaaatgaaaggcattaaaaattgggaaaaatttatatttgacagtatcttaacaacgaattctgcttctatatcacttcctagctttctgatgataacttcccgtgcagatctgtatgtaaggaatggacgtagtagtcatgctaatctgagtatttatctgtgtgatacttacgaattaacgatgtaagttaataagttagcatttcgtgaacctggttaataccatttgctaaggttaaattagccaaatcctgaagtaagctgtaaaacatccaaggtagggtagagaggcatcttatgagaaagctggccaactctcctggtcaccttctaatcttcctaacttcagaaatcaaggcagagagaggaaaatagtaattactttgtaggattagatttatggttgtcgaaacctttgtttctccagtgcagaatgagatagcgttttagggaaagccaaagactcagatgtcttcttcatgctcatcgtgtggaatttttcttcctttagaaatgtattgtctctcagggcttaaagcaatttgcatctttcgatgagacattgagtaataggcaatattctctgaaataatttgtgcaggctgggcacagtggctcacacctgtaatcccagcactttgggaggccgaggcgggcaggtcactgaggtcaggtgttggagacgagcctgaccaacatggtgaaaccccgtctctactaaaaataccaaaattagctgggcttggtggcacacacctgtaatcccagctacttgggaggctgaggcaggagaattgcttgaacccccatgggaggtggaggttgtggtgagccaagattgtgtcattgtactacagtctggacaacagagtgagactctgtctcaaaaaaaaaaaaatagaatttgtgcagttccccccacccccttttttttttctgttggcatttttgctatcatttagctgccttctttatatcctgaaacttacaggtggtgttggtctagtcagtaagagcaaaggctttgggaatagatagatctgtatttagaccttggctctagcatctcattgttatgtgacctccatcaagtgacctaatttccctaatattcaatttcctcatctctaagacagggagttaatattgcctctcttatagaattgtgagaaatatagtcatgtgtcgcttgatgatggggatgaattctgagaaatgtgttgttgggcgatttcattttgtgggaacctcacagggtggacttaaacaaacctagatggtatggcctactacacacctaggctgtacggtatagctcctgtcttcaaacctgtacagcatgtgactttactgaacactgtaggcaattataacacagtggtatttgtatatataaacatagtgaaacatagaaaaggcccagtagaaatacagtgtaaaagattttttaaaaaagctgggcatggtggctcacgcctgtaatcccagcactttgggaggccgaggcaggcagatcacttgaggtcaggagttcaagaccagcctggccaacatgatgaaactccgtttctactaaaagtacaaaaattagctgggcgtggtgttgggtgcctgtaatcccagctactcaggaggctgaggcaggagaattgcttgaacccaggaggtggaggttgcagtgagtcaagattgtgccactgcacttcagcctgggagacagagcgagactctgtctcaaaaaaaaaaaaaaaaaaaagagataaaaaggtacatctgtacagggcacttaccacgaatggagcttgcaccctgggagttgctctgggtaagtcagtgagtgagcggtgagtgaatgtgaagacctaggactgtgcactgctgtagactttataaaccctgtgcacttaggccacactcacccctgtgatacgagtctacctactgtataacgtacctgcatatgtacccttgaaactaaaataaaagttaaaaaatttatcttcttttgccaataataaattaaccttagcttactgtaatgattcttctttatgaattaaaatctttttactcttttgtaataacacttggcttaaaacacaaacatattgtacagctatacaaatatattttctttatatccttcttctctaagattttttctgtttttgattttgttaaatttgtttttactttttacattttttttgttaaaaaccaagacaaaaacccacacatcagcctaggcctacatgggctcaggatcatcagtctcactatcttccacctccacatcttgtcccaccaggtcttcaggggcagtcatatgcatggggctgtcatctcctgtgataacaatgccttcttctggacacctccagaagggcctgcgtgttttacagtgaacttctaaaaaataataaaatgtatagtatagcaaacacataaacatagtaacatagtcatttattatcattttcaagtattatatactgtacataattgtacatgctagacttttacacagctggcagcaaggtgagtttgtttacaccattaccaccacaaacacatgggtgatgctttgcattgtgatgttacgatggcatgatgtcactaggtggtaggaacttttcagctccatgataatctaatggatacttgttcctgttggctgcccgtcgttgactgcaacatcattatgtggtgcatgactgtaaattagatactgttcagaaagctttggcacactggtaatagcaaatggtggtggcaaatatgatgatgatgatgatgatgattgaagacatagatggtaaaattttatggtgtcttaaaagtaccctctaaatatgattatttttatagtctgtccttttgaataggcacttaagaatgtatgaacttaataagtatataagaaagaatgttccccaaaatatatcttacagaggcatacaatttaagaattcaaacaggttgtaatggggtgtgtgtgtgtgtgcacacgcgcacgcatgcgtgctcattcacactaaagaattcttgggcatatgttcctgaatgtcctaaatggacattctaacatcacttcattatgggcagagggaaatggtaaagaaaaatttcatattatattattcagccacatattgacagcatctgttttatttgcctatggtaaagaattgaagcactgttaatttgctttttaaatcatgtaggcacaaagttatcgaactttagatttagaaatgaaactggaaatcattacactttccctttcctatccccaccctgttttggagagaaagagtgtgaggcttagagagttataaaactgttttaataccatgtctaagattaataactgaacaagtttctctttttactcgtgttaaagttgtactgccaattaacttaaaagaaagaaatatgcaatttctaatcctgatataggatatgggtatataaactctaacttgatgagtgaaacaaattaacttatttataatcagtttcatatctttatttattgagtgtctttaaataccccttacctttaaagtaagaaatattaaaatcaagcagaatataataatgaaaaattcttaagatatacttactaaaaacttatccttcggttaatacactgtatgtaggttgtacatacaatatgaaaaagtatatttttgtagcctacttttaaatccagaatagaggaggttaagaaggttgtgataaccatgagctctttttttttttttttgggacaaggtcttactctgtttcccaggctggagtgccgtggcacaatcatagcttactgcagccttgaactcttgggctcaagcaagccttccacttcagccttccaagtagctgggaccacacctggctaatttttaagtatttttgtagagatgagttctcactacattgcccaggctagtcttgaacccctagccttaagcgatcctcccacctcagcctgcctaagtgctgggattacaggtgtgagccactgagcccagccctcttttatttcttttgatagtacactcataatcattaaactatcatttctggatgtgagattgtgcttttggattcttattttttctttataaaatactttttgttctcttactggagaaaacattgttggattataaatgatataacaaggaatgaggatatacatactataataacgattcagatatgttattttcatattttatttaactgtagccatgccacaataatttagagttttaaagaacaagtttgattgaaatctaaactttgtacaatcctgaattgagaagtttcctgtattttattatgacacaatatttacctaaaaatagggtaattatgaattgagaaaacatagctattaatttcatactcttatttgttaagtagattttgtctggaaaactgttcatatttaaaggagctttgtacctttgtattctttttgtttttccttgtttatataattttaaactctgtttatggatttgggattctaactatgctaaataataaattaaggcattgaatgaagtacctagacagtattttgattaattttattcccccattcttaatgtgcatgtaactggaaaattaagagtggcttccaagggatctactacaaaagtaaggttaatatgatctcttttaaaacactgaaggcgtgtagccagtgttgtcattaattctgcagtagatattttcagcacttatttacatgggaagttagagcagagtaagatgcacctgtaaagctaaatgccacttatttgcatatatataaaacgcaggatgaatttaccatagaaatataaagggtacttatagaaatgtattagaaaaatatatgaatttttaacttatatctagaagttaactttatacatttaactttaaatcattaatagtggtttaacaccataagcggatgtttatgcatcatcattttatgaacaaaagacattctaattttagaaataaagtgattcaaaagagaataaaatatcttactttttcttttaaaattaatttgtttagcgcattacatgataatagctcaagcttgtgtgatttttccctaaaaaattggtttataaatattacatttatagtatgaagaaattaatcatacatagtttatttatctaatttctaaatacccatggaagaaaatgaatttaatggaatgtagttgtgtattacttggtttcgagtgtgggaaaatttatatggtctttctaaaacagcactgtcagtagaaatacaatgtgagctacatatgcaattttaaattttctagtagccacattttaaaaagtaaatggatgcaatttattttgataatataatttaattagtctactatatttaaaattttatcatttcaacatgtaatcaatatgaaaattattaatgagatattttacatacttttttctgtaataagcctttgtaatcaggtatgtactttatatatacaacaaatcttctgatgctaaattttaactggaaatacttgatctgtgtttagcttttgtaaaatttactgttgaacaacgtggactaatgtgcctaagtggttccaaacatattttaaaatttgaagacaaataaaagggaactcaaagtaaattgggatacatacatacaacagaatactgagccattaaaaaatgatgaaatagtaaaattgggggaattttgatgatactaggatgatataatgaccaagagacaaatacaattttagtttggttgagagatgtgatcatcacgttgctgattttactatgtatagaggttatcttttcctttctaagattttgaaactttaattagttaacccacttacctagtttctattagctgtgtaactttctcttcctgttttttgttttgttttgttttgttttttgctttttaactgcagtattttgaggagtcttggagtagcaagctaatctttggaagaaaggaaaatataaacctgaaaactaacaatttaaagaacgtcttttcaggttgtcatttgaaaaatacttgatttctgatcactgatttgaattgagtgtcaaatatttgatatgttttgtaaattaggtgaagatgagtgagtaggttctaaactgcttgggtttaccgcactctggagcattgcagaagaatgtgatgttggaaggaagtgctgaaacataattattggcttgcctataggagggtgctacataattttagaaggtgtcaagaaagtgacacagtctgaattagttctgttgagttgcaaaaaatgtaaagtttcttgattctgaaaataagaaatatgttcccagaaatctcatctagttaatgtgcttttaaaatcattgatgtctcttgttattacaataatagccattgaaagaatcttttttattagaatgttatttacaggtacgattagcttctatttaaataaattatttttatacttgatcttaggcaaaaggccaacaagtgatcagaataaattattttaagagaaaactaattataattgatatttggaattggaagcacaatttcctttagaacaattccacgaatggttgttttgattctcaaggcagcccacaaaagacagtttgaaacacaatttatgcagtgtcaatagtactgacctgactttggatcttggaggcaggggcttcaggtgatacccgagtggagtttttactccatttccattccgtaaggctataggcatttgaaagaggaaacttttctttggcaaccttccaccttcctttctacagaatatttcagtatttctagctcataggttttctaaaatattctctgtaatttattttgaaatggagtttttttatcgtttacagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatactgaggtattaattatatatagaattttcataaagtgtcagtttgttcaatttgcatatcctagtactagaatgctgtatttttttgaactgttatgaattctgatatgattactttctctatgtgctacatttcctttgcttttcataaatatgatctgagaaaagtgattaaaaaaaagacagtaaaagggaggtttagtccatctgtttagcttattatgtagaatgtcagcttaaattttacctgtacctcatattgaccgtatagcctggaaaatctttcggaggtatagttaatggatttaagcatatggcagtttatgtagttaatgaaagtgaaaacaaattgtattataaatacctcccaaactggtttattatcattctatcattcttcatgctctgttagtatgatattgaatatctgaggtaccaggattattgttgcttgtggctctgagcatttcgtagtgcttttgcatgatgagagaaagattacaaatttagtattatgttagatggtacgttttattaaaatcaaatgcttcaaaaataattgctctgtgtatggcatgagataaatagcaatcagatatattgtttaataatatgactctattaaatgatggcataaatttgaaaatttgaccttcggtatcttccgggtctaaaattatatgactccattataaatattttggaaatgattaactaaaaaattgtttcaattcttagttggtaaattcaatgtggtagtaggtggtggtgattattttgtattagagaattaggaattacacttagttctaaggtaatctttataggatgtccagcaattaaacccctacttttttgaattgcttaaaaataagggaactgatctttttaaattctgtacttgagttacgtctgtatatatagtcatgtcctagataatctaatggaacttaattagttggaaatctttatattgtttataactgaactagctataagaggaacattaaagaaaacatattttgagtggaggtaatgaaatttagcttctaatgctcagccttttatttctgtaatctataccagatacctaagaccctcttattgtttcccagcttcaacctgtcagtatagaaaacggtgtaacttactattttttctcaatattgaagcacatttgtagtgaaatattattttaactatatattgccatttttgctttttccctatttcagtaacatttttcgctatttcagtaacattacatgtcaacaagagaatggtgggtattttggggggggttgggtgggaagaaattttactaagcttgctagattctaaaaggtataccttatttggccccttttccccatttaggggaacaagggtgttggggctgggaagtagataagaggtgagtaagtcatccaaagcatatgtcttcattagcctccctgtatgaaaagctgatttctgtagagtgttggaggcctactttcagaatctgtcatatgttaacattcatcttctctactgacctgatttatatcccttagtctatttcattttataattatgacaaaggataaagtcattagaacaaattctttttattagttgacgtattgttgtgtttatatctcttgtgtttgttattaagatggaagctcaatcatgtccttgtttaacagaaaggtgatgtcttggcattgataattctgattcaatatccataggtacatggtggattctttaaatatttagtattcttttatttctggaaagttttcttaaatgatagtttttttaaaatttcatttctataaagttttcttaaatcatactttttagtgttttattccattacttcatatttcttcttcaggaactcctgctatacatgtatgttggatcttcattacccagcttcaatatttttcacttttcatgcattctttttatttcttcatttctctttaaatttttttcttccttttcaccttctatttctcttttaacataattgtatttatttctgtattccacatagcttagtattcacttattttaaaattattttaaaacgttttttagatttaaaaattctttttttatttatatatacatattttatttttaccaaaggagcaacactattaactgaagacttctataatttttttcttttatttctgattctttcttcggttttccccctcagttttgaacttttctaattttgatttgtgatgtccttttgtattttagataattttcctaatgttttccagctcatttggaaaggctacagttttattctgtacctaagcaagtctttctggtgtcaaagatttgaccttgatacttttcttttgctcattttcgtatgagattagttttcctgtactttcaaaagaaggcgtggttcaagatggctttcccaatttcacatctgtctctaatgtttttgtgtaatgtctaaaatatggaaacttggtttatgagatctactctgccatttttatctgggctttctcttccttttgtctctgttgtacctgtcctgcttggttttgatttaaccccagtggtttctcctgaatgtggagccttctcctagaaggcagcctcggctagtcccagggttcagagtagccagctgctctcttcacctaagagaccactgtggattccttgtactcacttgctattggcttggacaaaagccctcccattttcagatgctattatcagattaatctctcattaatctgtctttccagtgtatgcctgtgggctatcttggggttctcttgttatcagacacctccctgctggcctctgctttctcccgtacagatgtcagtactgtgcaggtcttaattgctgttggtggtttgcccctacattcttacagttttagtttcccaaggatacctttaaacttggttttattgtaaatgtcgacaatggattttgggttttactatctagttctgtcttaattctggaattcagaaagattaaaagctctgttgttgcagctgctgccacctcttcccagtaccctctcctcctatgtcatttttttcttcttatttttcttgactgtataagagagaatgtatgacatttcctgcttgaccgctgagtttgattataaattaaaatacacaatattttatacaaattgttttgtagaagatttatttacagatgctcattcacaggtaaaattgacttatgaaaatagttttcatgacaaatgtatcaggctcggtaactaaatatatggattgatcttgtttataaatgaaattaaatgtgaatgtaacttacatatttctgtatttgcttacatccgtatgtacacatataatcagcaaatgagttgatgtttcctattcgtaacttaatggtaatagcttggtaacagagttgggagtattaaaaagatgtaaagagccccttaaaattttgttgctgggaattttagtgttctactgatgaaggaaatagacactggaaggtgttgtttctattaggtaacttagatatcatactgaagacttcaaatacttattgttgacactcaaaagacacacttagtgtaagtaagcatttccccgcttttcccaatgaaataagatcattattataattccattataaatgctgatgatcatatttatagaaatatagaagataagacttgaaatgatattcgctaccaattaatgagtttgaagaagaaatcaggatgtgttttgctattttacatttattcttatttaactccaaagaattcagtgatgttatgtactattatttccatttctctgtgaagacgttgaagcttaagtaacacgcataataaggtcatacatttagcaagtggctcaattaaagttcaaacctggttctgcctggtttcaaagtctgtgctactccatggtattaggctacaacatgacttagggtttcttcctctgctctattgctgttcagatgtactcctcttttggcagagtgggagaaaatttttgcaatctatgcatctgacaaaggcccaatatccagaatctacaaggaacctaaacaaatttacaagaaaaaaaaaaaaacattaaaaagtgggcaaaggacttgatcagacacatctcaaaagaagacatttatgtagccaacaaacatatgaagaaaagctcaacatcactgatcattagaaagatgcaaaatgccttttctgtatgccaccttatatccccagtatttattatttctaagtcatagtatcttacagtgtatataagtctcatccgttcttttgattttctcttccctgcttgcaattgggtacctaggaacaaagttgcaatcttagccagttttttctttagcctttgctgatgtgtgaaaagcccttttttctaccctggatttctgtacttaagctggaacagctaagtttttaccttttttaaatataaagtttcagagtcttctgccaaggatcttttgctgttttcctactgttaaatatttcaaagccttttttaaacatagggaatataatcaaacatagcaagcagctgatgaacaatatctagatagtcttcattattgaaatggaataaatggtatttttgtattttaggctaacagacaccttgtaccttagataaggccaaccttctcataaaatccctcagttacttttattaataataaccaaattaactctggattccagggtgtactcatgatggaatgatttctctgtcatgttatcctgaggatctagtactctgagataacataagtgtatgacactttaggcttatgaaacacttagctacttaaattatttaattttttttcatgtgcagatggtattgtacccaaacactacctttgtgtgtgtgtgtgtgtgtgcctgtgtgtgtgtttttgagacagggtcttactctgctcaggctggagtgcagtggcgtgattatagctcactacagccttgacctcctgggctccagtgatcctgccaaagtgttgggattgcaggcgtgagccacctcacccagccttaaattatttttttttcaaggatgtttaacctgagggttagaggctctttggcacgtgagctgctgaaatgtgtgtgaaagtgttgtgcacgtgtatgttcctctttttttctgggaagtggatctgtagtgattcttagatgagtctatgagacaagaaacttttatttttttcatttatttagcgaatgtttgttaagcgtactatgccttggccactctacagggtgctgattggaccagtctgtctacctaccgttgtagatgttagaagctatattcttttcacatgcctaatataactctttgtgtatgtatacatgcccaggcatgttccttcctcagaacattaaattcaccattttggtcaactcaaagcaagtacaccatgggacacagatctgaaataatgtccagatttttacttactgaatgaggtgtgttgagtgtataagactacatgatgagatggcaagtaattgcctgaagaaatgatgtagtgattttgtgtgtcttatatttatttactttttgatccagaaataaattatatagataccactattttgtttggatgggggagaaaggatgggtgtgtattcaggaacttatgttacttttttgcaactaataccccttctcagtagtacaaagatttgatttctttttctttctatttcctacagacttcatctgcagagagaaagagacgattacctgtgtggtttgccaaaggaagtgataccagcaagaaattaatggacaaaacgaaaaggggaggtctttttagttaagctggcaattaccagaacaattatgtttcttgctgtattataagaggatagctatattttatttctgaagagtaaggagtagtattttggcttaaaaatcattctaattacaaagttcactgtttattgaagaactggcatcttaaatcagccttccgcaattcatgtagtttctgggtcttctgggagcctacgtgagtacatcacctaacagaatattaaattagacttcctgtaagattgctttaagaaactgttactgtcctgttttctaatctctttattaaaacagtgtatttggaaaatgttatgtgctctgatttgatatagataacagattagtagttacatggtaattatgtgatataaaatattcatatattatcaaaattctgttttgtaaatgtaagaaagcatagttattttacaaattgtttttactgtcttttgaagaagttcttaaatacgttgttaaatggtattagttgaccagggcagtgaaaatgaaaccgcattttgggtgccattaaatagggaaaaaacatgtaaaaaatgtaaaatggagaccaattgcactaggcaagtgtatattttgtattttatatacaatttctattatttttcaagtaataaaacaatgtttttcatactgaatattatatatatattttttagctttcatttacttaattattttaagtacctttatttttccaggatgtcagaatttgattctaatctctcttatgtagcacatgtgacttaatttaaaacctatactgtgacacagagttgggtaaacgatgattatttaactttaagcagttcaccatccatttcaaagcctttgattggcttttttgtaaataaaaataacttgttaagaaacaaatatatctgtcatagaagaactagaaaatccagggaagtgagaaaaatgaaaataaaaatcattcatagttttactagtagctaatcacagtcaacctcttttgtgtatcccaccagacttttttatattcatttgtttttaggtaaaatataaaagtctcgtatattcccatttttctgcattgcattaccagaaggtagtggcgcctattaaatatgtgatatgttgttgtccagccatggcttctgcatttgcatgcttttgtgtgtgcatctgcaataccctgtgaatatcctgtgtgatggagtggcaagtacgcacagacacgtctgctgcatgcctaggtacgaggctgtctccaggagaagcacttgtttgattatttgagttgccaattgaatttgctgctttttttcatggcttgccattttcactgaaaagaatgactaatgaaaaacgatgattggttattagatttggatgtttggcagacattttctcaaaattgaactaagttggcctcttcacggaaaacaactggtatttgttgtgccaatgataaaattggagatttctagcaaaatgtataattttggaaaagttgtgttcctccactggaagcttgacagctttccttaacataaagacttctctttctcttcgctttcactactactactactaattcttcttctgattcttcttcttctccttcttccttcttccttccttcctcctcctcctccttcttcttcctcttcctcttcttctttctctctttccttccttcccttccctttcccttccttccttccttccttcctgccgtccgaccgcctgccttccttccttccttcctccctccctccctccctccctcctttctttttctttctctttctttctttctttctctctctctctctctttctttctttttctttctctttttctttctttcaagcagtcctcccgcctcagtcccccaaaatagtgggattataggtgtgagccaccatgcacagccttacataaagccttttctaatgagatggatagtaattaacaaatgtgagtttttgatattatataaagattttttctgtgtttcgaagatccgtataactcagtgaatcagtatgttctggatgactaatatgtgatgttaagaaatcatgactgaggccgggcgcggtggctcacgcctgtaatcccagcactttgggaggccgaggcgggcggatcacgagatcaggagatcgagaccaccctggccaacatggtgaaaccccgtctctactaaaaatacaaaaattagctgggtgtgttggtgcgtgcctataatcccagctactcgggaggctgaggcaggagaatcgcttgaactcaggaggcggagattgcagtgagctgagactgcgccactgcaccccagcctggcgacagagcaagactccgtctcaaaaataaaaaaagaaatcatgactgggtaaaagatctgttcagagtacaagatggaccaatggatttgatatatttgaatataacagagtatgaaaaagtttattgatatagtttcagattacacactgcaactaatctttaagaaactattacttgtccactttttggtaaaatttcagagaacaatgtccaccattatctgaacaggctattaaaatactcttctcttttccaactacgtgcctgtgcaaagtcagatttttttcatatacttcagccaaaacagcatatcaaaatggattgaatgcagaagtagatctgagaatacagccacttttgttaagccagacaatgagatttgcaaaatgtaaacaatgctgctgttctcagtttttaaaaatatgttttttaaaagtatttatgttaatgtgtacttggtttactactgctatttttaaataaaacaagaaacatttttaaatgtctgttttaatttctaaagtggtagtgatagatataacccatattaataaaagctctttggggtcctcagtgatttt

SEQ ID NO: 36 - DNA, 9174 bp, Human
tgagccactgagcctggccccttggttattctttagattgataatgtaacagacagtgtaaatacatctacaaattcagaaggttaagaaagggtatgcaaggaaaaccggtctgtccctcagtcacatttttcaccaccacccacaagaaggcattgctatcaatttatgtattcctcccaaaacattcaataaatgtagaatcagttgcatacattcatcttgcttttattgtacacaaacagtaccacactctgtactttctcatttgtacttagctaggagattttacttcagttgaatcactttacttttagagatttttctctataagaaaatcagagttgctctttcttgttgatagctgtctatcttccagtggaaggatgccccaggatttatgtatccagcacctagagatgggcatttaggttacttgcagtatggcttccagatagggattggttcgcgtattttttcacataagtttaaaatgatctctcacgtctgtctcatcatctgtaggataaacagctgagggtggcattgttagcacagaccattctacctccagcttcagaatttcagggtagttattattttcacctgcccttacaccttccctgaagggagcagcagggatcatttccttgaatgtaagaatgactgtcacttgaggtgattcagcaatgctctactgttttagagtgttttagccagattacagagaaaggcatttacttagggcttgcttacagtaaacaggactgtatgggcatcagaaatgtgaattcttgttcaggatccaccgttatagcctctgtgactttgacctggcaatagccttccttctctggcctcagtgttctcctctataaagcaaggggctggacaagccatctccagtttcccagtttggcaacaccactcctaaaggatctgaagggacaacaggaggcccaggcctggaggtagggtagccctgagcctgtgcctagaatgggaggcaaagatggtggcaggtgggtgggaaaatgtggggtttgggggtcacaggagagaccaaggggcaggcctggagcatggcacgctccctgatcacagctctccactggaaggccatggagggagtgatggggagagcctgcaactcctggagataagcctgattctgactttctttgaaggatttttttctttcgacttctttcctgtgaaagagaatatccgagaaatgagaattttaactaaagagaaaacctttgcatttgctactgataaatatctggcctatgcgggaaagtcatgggtgccctgggattctggctccactgctaacaagaccttgttagaccttcttaactgcccctccagagaggagaaaggctcttggaggtagagtgagattggggagcttggcagagccctaggatgaactgtgtttttgttttgttttgttgcaggttggagcctttttcctgcagaaagagaagcaattccgggcttttccacagataacctgctagggctcgcagagacctggattctaaccccatctcgcctttcctcacctggggcattgttttctgcgtttgagaactgctgggtgggctggtgttacccaggatttttaaatttttgcaggagacgctttgcaggagatctctagggcttttttctgtgtcaattaaagagcctggccagctggacctgggctgtctttttgacaaaaacaaacgtcatccccctcccagctgagcacttgttagaactggactttaactgagggcctgaaccccctaacaacgggacaaacagtatgaaatcaaaaccgtttaccctcctcccaccagcggtttgcgtagggccttgggtgcactagcaaaacaaacttattttgaacactcagctcctagcgtgcggcgctgccaatcattaacctcctggtgcaagtggcgcggcctgtgccctttataaggtgcgcgctgtgtccagcgagcatcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcaggtaccacagtcccgcccctgctccagcacctcctgccgcccgcccccgcccggcacctcccgcccccactcccctaactactgggtggggctgcagccgggcaggggcttgtccacaactagagcttgaaaccagagcacgtagttggggaaggagcttgggtcacccagtggagcccgctcattgcacggtcttggcaggacgtgctctgggagaagaaggaagatgttccagggcacacatagcttagtggagactcaaggaggaagctcccacttggccctcgtagcccagagatctttagagacccagacagcaagagtagagggaggcggtggggctgcctccgcagttgggatgccaccctgggtcccccaccagtctccttgccagcacgtgggcagccccagtggctggagcatccgggaaggcctaagaagggaatccctcctgctggcctccccaggaggtgtttggaatgtcctttgtaatatacgtcctggatacagtatgtgcttcccagatgtttacagaacataatgtgagagttgaggctaaaagcttcacttccattcattgccatagaaaaacaatgtttgatgtgtatgttgccccctaagaacatgacaatcaggttctttcctggatttaagcaggcatttgtttgtagcgggaagtggaggaaatgcctctttctctactccagcccctatctcctcatctggactgcttgcacgtcctgtcctgtgccattcttggaggaattaggacttccataccctgatagggtgttagagtgagtgtgtgagagtcagtgacccttccaaggagggaacagggatttcctgcggattctctgcccttcagaggaaatgaaagggagtcgtctcactgatcctcaaggagatggatttccacagggggtcccttataggccagtgtgctgattctgttcatgtacctttggactctatctgcaagatcctcttgccatgggggtggagggggtgttgcagagaagtccattaggacgtgggaaggcaggggccccaaaatagaagagggtagtagtttgggtcaggagagctgcattctagactccacttctagatgaactgtaccatccattcagggatattagtaaaatccccattttaaggatggagaagctgaggtttcgaggctccctactaatgcggttaggaactgaactctaatcctggcttctttagggttgttctcaacctcagcaaatgcatttgttgctctgctcccctgctgctttaaaagcagaaacgtggggcacccttgccaggccctgaaacttactattgtcaggaacagagctggcatgctgttgggacataactcttcctggaaaccattacaaggtcctttacagtgagagtcagtgaaaatcaggttagggaatgtggccatcctcatggcccagcctggttttgagggaaggaagtgatctcctgggggcccgaaaggggcagatgctttgggagggctcatggggtctgcaatgtttcctttccagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggtgaggcccagcaggtgggtggtgggaactctcctgtcagaggatgtagcttgagtcggctgtgacaagcagacctggcccactccttcctggtcctgatgccctggaaagaaatgcttttcccccaaaacctagtggccatttctcagttaaactttgtcaaactgtgaacacatggactttcaggagaggagcccactggatgcaaagaaaatgtagttccggacgataggttacttcatgtctctgagctcctctctaaagggtgtgagaacattgagttacattgttccaaaacttagtacaagggcctaactgctttcacccccattgtatgatttgcctccctttaaaaaagttgtcataaaatagacataaaatgtactgttttaactattttgaagcataggtttctgtggcattaagtaacaataagtaatgcatgttattctgcaaccactaccaatatctaccttcagaattttcatcttcccaaactgaagctcggaactcattaaacatcaactctccattatcttaattatgtctgttttgaattctaccacttgagggcgacagagaatcaaagtcggagtgatttgatttgagaaaataaattacttccacaaacatgcctacccagaaaaagggaggattaaaccattttctcaacattttggaatttcatctgagaataacgataaatggaggaaagttaattcttaaattatccaaatgaatgccttaatcctcacttgatttagtttatgtaaaagaaccttgtagattgcagaggaaagttattcaaaatctagaaatgtcttctgctaaattcttaattaagagttatgcccactcttctaaccagatggcgggtgccaaaagtattcagtaggtggcaggaagagttgggaagagttttgtggtgttggtgaggctcttgccaggggatgtctctgtgcaggtgttgagagagtgattggtgagggagagaatggtgttcttgttctttatctgaacaacttaagacagactaactgcaggtgggaaaaagaggcccagagggagcacatcacatgacacctagtcccaggtccccgtggccagatcgtagggccactcctgcttctacaaaacctcttccatcagtcattgtctaggctgataattcactgtgtcttgttagatatgctaatgtcaagttattctcttaggagccctgccgaatagaactctacagagtcgtagagagtttagccaaggcacaggagacatcaggagaagaaatttccaaattttacctgccaaactgcaacaagaatggattttatcacagcagacaggtaggtggccttgccagtgtgcgtcgtcagggtgaaagggactactgccctacattcctgccaagccacggtcattcatgtcaaagaaggtccactccaaagtagacaccagaagtggttgtattgagccagatccacccctctgggaacctggaacagctaggtgaagaaagcctattgaacaggtcaatatgtcaccaccagaggtggaaaacctgcgctggaccaggggccctggggctaagcctgagctccatcactcagcaagccaatagctatggaagactttcctaggccccctaacgcttggatcttgggttcctcacctatacaagagaggaagggaacaaacttaacttagaaaagcaagtatctatttggacagctcttaacacttttttctccttgaactgtctaataaaacacaacaacatttttgtggcttgccagataataaatgagatcaaacagaccaagatttcatattgaggagtgctttaggtctcagtgaagtacaggttctgtagattttattgggagaaactgaggactaggccctgcttcacaggcaatgaacagtggggcacacacgagacatgttccctctgggttgggctcccctgacatcaggctatgaagcagacagctgtgcacacactgtactgtttaacacacatgggaagtcattattgcacatgccactcggtcactgtctctattttatgatgagaaccaggagggtgtgagatttgcctgcatcatgggcagctggtttcacagccgggactcttggcttggctctgcagtgctcggctgcactgaaaaaagggccagctatggctctactttccctgtcagcttgtcatctgctgctcttgaccttggtcttgtctttgcagtgtgagacatccatggatggagaggcgggactctgctggtgcgtctacccttggaatgggaagaggatccctgggtctccagagatcaggggagaccccaactgccagatatattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaatactgttatctctgtggatgtttatttagtgatattatctttttgaaatccctttgtccttcaccctcaccttccttatgcattttgtgcttttgtgataccaagatggtgttttgggtctgcagagccccttgtcctaactaccctagatcttgccccggctgccccagggtttccacttcccagtggcattgggaccttcctcctctgcctggccaggctgggcattcctgtgtcccacctctccattagtccccatcctccccagggtcctcagcctcttcctcttggtttggtttgtcccttccgttcaacttataaataggaacagggtttctttcctcttaaacacaagacagaagtgcttccttggttttgctccctagcctttcccttgcttgccctcccttcctgctagcctccttcttccacagggctcccagcatccttttgtcacttctgtttccatgactgagccctgattgcatctctcttctctgctcctcagagctcttcttccttaacactgtgccctgcttggtgtgcccaacgctgcccctcctaactcttgctcaccctgttgactgcttctttcctcccctccacatctttcctagcaccttgcccatcccaggggattccatctcggtctgctggctgcctccagccctgtctcttggactccccctgctctatgtcggggtgaaagcccacacttctccttgcctcaggccacctcttggaggcttggcatccatggctgcttctctcatctgtggggctggtggcctccctgacattctggtttttcctggagactctagctccctatcttgggtcccccctttaaccctccaaccccatagctgccaggctgccatcctctctgccatgaccctagggctggtgtgtaaactcagcactcagactcatcaagaggagcagccagaccgatgtgggacagggacagactgatagctgcagcccagggccaggaggtgtgttcatttgctcaagcaatgaaaccacatctggcacagcagctgcaattggagtcaccactccattaagcttataataattcactgttattgtctaagatccaactgtcttctgcacaggccaaatagcagagttcagtggggatgtggtgagaatcaccactcctgcatctttcaagtccttgatggtggcactaatttctgccatctctctgggattgcaatatggcttctgaactgatcaatgacagttcagagccagtgccctgtagttcctgaaaggtctgattacttcctttccctcaatccacaattgccccagtgaaagcctctaggtccctttggagaacactggtagaaatattttcaacagtgtactggggccctttctcaagggggcccagcccctccttcattcaaggggttctgggtctgtaaactggcttaagtctgagaattgattgaggtgccaagactctgtttttgtgattcaaattagatttttgttcacttgtccttgaactttcctgcttatacaagtcaataacaatttagtaggcttcctatcagtttcacttctaggaatgtcatgatcaagtagccaacgtcatagatccacaggagtctgactattctgagtgctgccttggctctgctgtccattagagtagctgtacctaccttgcctttgttggttgagtgcctccacttggtccctgccacccttggactctcattatttccattgcatttatgtttcccagttcagcagctgcagttcccactgtacggtctggcctacagagaagagcaatgccagagctcttctagtatgctgaggctcccctcataaatgtattccttatggtcaaggtgcaagataatgccctttggacctgcccatggtgggtaagaaagtcttaaatgacaaattccctctaacattctagtgtccctaagcctttgagttcatttctactgtaaatcaatgcagatcttg

SEQ ID NO: 37 - DNA, 66788 bp, Human
cctaggtaccaaaaggatttctgctttaaagaaaaggcatttccacaatgtgggcattttaatccagctacaccaaatagcaagcatgctaatctttgcccaaaaagaaaggactttgtagtcagggtgtccattttgacaccactcagtactagagcctacgctaaagtgtagtgacaccatcaggtaaccactgggagaccatttttgctggctacctgctatctgccttaccttacttctgttatccctgctttcctaatcacaatcccacctttaagcacccaagcaagatgctatcctttccatgaaacttatccttcccaaggagagatgttgtggagaaaaatcaatagggagtggtggtggtcacaatggtagtataacttaaacaaggatggtggcagaaggcctcccttgagaggaagggaagaggcttgccatgcagatgtctgagtgagtgtagcaggctgagagaatgtcaagtgcaaaggccccagggtggaggctgctgtcagagaacagcaaggagggcagtgtggatggcatagtaagcagaagaaagtaaaagcagagaggatgtggcaggaggggacacatacggggaaggactttggatttcaccttcagatggaagcatttgaggggctgtgaaccaagtgatgacctgatttgtgacttaggatttaccaaaaccactctgtgtatttgagaaagagctagagagggacaaaaagcaaagcaaggaaacaaggtaggaaactaatttggtaaaccatgcgaggctaggattgcagtagcattgcgggatatggtgaggggtggtcagacgctggacatatgttgaaggtagaaacaaaatgattggtatttgagaaaagagtgtgcttaaagactttctggaggaagtagaagtctttgggaagactgggtttgtgaacaagatcaagaaaacagttttggacagggaagtttgagatacttggagataaattattggatgtgtaggagagggtagcggcatgcaagtctggagttcagagaagaggtcagagctatagatgtcaatgtgggagtcatcagaatataacgtaaagccaagatttctttaggaggcagaaaacttacaggcataggaaagtaaaaaaatttaaaaaggcactactcccccatccccttgccattgtttccatgaaaggtgagacaggaccaggatactgtgctggagggacagttttctagagcaaatataagaacatcttgccacctagggacctaccaggacctttggacattgtaactcctttaactgggaagccatcactcttgtcggaagatacactctggtgcagcttgtcatctgggggactgagtgagttccagggtcatgttgtctcagagtgtcttcctccatcaggcactggctaagcattaagaatgctctagtggacaggacagatgacgtgtgccctcaaggagctgaaatctagcaggataaatagatgtaagacaaacctttcattacatattggtgagtattccaaaggaaaatgctggggtagggttcaagaaaagactcccatgaggaagacattcaagtggagacaagatgagtaggagttgagtgaggaggctgagggaagagcatgtttgaggatcagaaagggtagcgtttggcctataaaagggagggagaaaggcacaagaggtggaggaggagctgcaaacgtagatgtcttcaagcaagaaacacacaagtaaagcagcaaatgttattcaataacaagtgaccaacgttttgagaagtggacagtgtgggccaggctgtacctccaggcacttgaattataattttaaactgcatccaaatgaactaatcactcctgctggcctactagttgaggggaagaagagagtctgtagagaagagagacccagaacttcatctgtgtgttctgctgtgcatccttgacagcacctggcacagaatctcagctaagatggatgaaatgcaagtactcaggccctttgaactagaatttttgcctaaactgaaagagttggtgagttcctttggggcagcactgtcacatatatactccttacactccaaagctctctgtcctggatcgaacatataatattgacttttcaatattgttgaaagaagattaattactcagtgattgttgagatgtgcattggcatttgaagctaaaatattagtggtttaaaaagaagcaaaacttgcctcaattccttttttttttttttaaacatttgcaggctgtgtaagttgacacttgccttgttgtattagacttccctagacccctggttctaaaaatgtggttcccagtagcctcagcattcattacctgggaacttgtcagacaggcagattctcgggtccccccaccctgcccctagacatgcagaatcagaaactcgggatgaagctcagtgatgggcatttaaacaagcaatgatgcacactaaagtttgggaaccattgccttgcacttgttcacacacacacacacacacacacacacagagagaatgaaagtgatccagagaagttcacctgtaactttcccctaattaataaaaactacagtatagctattccaaacagactgatgagaaggccttgtttcagtttttagaaaattatttatcttttatccacttaataattgttactattcttcaagataaatcttaaacacagagcattattacctttcctgtaggagcctctgagtgactggtgtttgaacaggccagcaagcatgttgcatctccttcacactgacttgaggtgattaacaaagattctcccaggagatttttaattggtgcatgagtcatgagcagtgagacaagtggaactgcaagaataatgtatcttacagtgatttggtctttgattttcttagcagttaattgaatcaggtggagagagaagccagttcatgatttggtaagggaagctagccattcagatggctattgtatgtgaatcagcttgtaaaatttcactttgctgagtcccccaaatctaagaagtgctaaaacatctgagaattggttaatgtgcaactttgtctttgcaaatacggaaggatttgtagaggcacctgtttctactacaaagccacagctggactctgaacaggtggtgttcaagaacatctcttttagcttttaagatgaaaatatggagttattaagctggagttattctgaaatttccacaaagctcaacacaaaaaaggctattataattcttttcctaatagaatgcatcaggatgattgaattcatcagtcagaattactaggggaggagatggttggaaaagtgacttaaaaacaggcacagggcacaacttttttttttttatgttccttataaagcaaattctaagaactacactttctgagaactttcaaagatctatcctttctcaaaagaatatgtgtccaatttaattttgtcttgcagacagcctacaaagcaagcctgctcccatgacctgtcccctctgtatggatgccatctgccagctcctcccagcagttctttgctgccactacctctttaatggcctccgtttctctatccacattcacccaggaatcttctcagtgatggcttcctgccagcagcatcaattccccagcctaccacttataccacattccaagctcttcatgctatgttatcttggatatattaccttggcttgtctcctgtgcaaggggctatccaccacatttatgtgtctcccacaacactcaagtcagcactgaacaattagtcacaataaacttagtgtataacattcaccaagtatgccttaaatgatttacctttatacatttaattctaacaaatctgtatagtagctagcattattattacccctactctctacaaatgaggaaattatataatccatttaatttctgtgtaactcagtaagtgaaggaggtggatttgactcagccaacaatctaccatggttccatagcctgtgtatttatctattaccctagaagtcatctgaagcaaataatctttgtttgattaatttaggaaagacatgtcttattctagatagagttaatgtaacattcctctcctgtttgtttccatgtcagacttaccacaagcctgacatgagttgatggctggggctctattgagttcatttgtttccttgcctagtctccagttacccttctgtgccatttccttttctccaagatgagaataatcatagtatctacttcctagggctattgtaagaataaaagaatgaaaaaattctcagaacagtgttttgtatatagttcagtaaatggtagtcattattattaaccttgttctgtggaggaggtgactgcggctcaagattattaggcaattttcccaaaaccacagtgcaaggggtagaaccagatcttgaatccagtgctcttcccgtcactgcttccagcagccatgtgatccaggtatggccactgatggacctcatcacatttcttccggtcactagtctgctagaattgcatcccagtatcaattccgtagctgtgtatttcactcgttcccaaagcgttagttagcatactgcagaacgtatgctggtcctaagtgggactccttcaatttttagtgcctgcagatttcaaatcagggcctattgctagtagtgagtaatgtaatctgctttggagaggtaagaatcaatggttattccatgtataggtgaatgctttaaagcctcttccttcatgcgttcttttgataaaccacctaagagacactcttctgactgctaagaaattcatgtgacaatggtactgtttgtgctaccacacaagctcctaaggaaattccaactgttatgttcacttctacttcaattgtggggaaagttttccctttatccttctccccatacaaggtatacagctctcccatcctgtgttcatggggcttaagtttggagttgctgaaagctagggatcccacaggtattagaaacatccacactcagggcagcccagcactgagtcccttctactccattcctttacccacacaggaagtgatctgcaagtgggcatattttagttcacgcttagatcagcagtttcttagactccttttcagtttgtttgagggttgaaggagcaaaaatgacatttggatgctagtgagatgcaaagaaaacagaaatactcagaaaaccaacagaggcattaatagggaaataactctgccgttgaccaatatcttattaataagattgttgggagagtactctcatttcttttagaataattctttgtagtttggatatttataaatacaaaaacctaatattttcatctccaagctcatatgtacacacatgcgcacacatgtgcacacacacacacacacattttctcctgccctaacatcactgactaaacaaatctactgcctggtatgtatttctttagataatgggatggttattttaaaatctatttaagctgaggtccagcagttaccactgctgagtcattaatctttgagacaaggcttgttgcaagcaaactaactgcagttttgtccctgagagttaagtgtgtgtcaataataaaattctaagtcaaattataattagtgcacatccagggactgagatttgtcagtgcttgatacttggtaagtactttgtctttaaaagctcacttgttggaaactggtttaaatgctttttaaaccatcttggagatggttaaaactgggagactattgggaaggtacaattgcattttgccatgtgagaagagcatgagcttctgggatccaggagtggaataatacagtttggatgtttgttccctcaaaatctcatgttgaaaggtaatcctcaatgttggacatggggcctggtgagaagttttgggtcatgggggcagatccctcatgaatggcttggtgccctgcccatggtaatgagttcacatgtgatttggttttttttaaaaagcctggcactcccacctctctcttgccccctttcttaccatgtgatatacctgctccccctttgccttctgctgtgagtggaagcttattgaggccctcaccagaaacagatgctggcactatgcttttttttttttttttttttttttaacagtctgtagaactgtaagccaaatagacctatttccattataaatgaaaaaaaatttcataaggctatagctgccacagataatgatttctcttagggctgagcaaagtaaattgaataccttctaaaaaggattctaccatttctagatgctgttaaaacattcatgaatcatgaaataagtttaaaatataattgacaggagtatagaagaagttgatttcaaccatcagggatgactttgacgtgttcgagacttcagtggaggaagtcactgcagagatggtgaaaatagcaagagaactagagttagaagtgaagcctaaaaatgtgactgagttgctgcaatctcacaataaaacttgaacagatgaggagttgcttctgatggatgagcgaagaaaatggtttattgagatgaaatctaacgctggggaagatgctttgaacattgttaaaatgacagcaaaggacttagaatactacatcaactaacttgataaagtggcatcagcatttgagaagattgactccagtcttgaaagaagttgcactgtggtaaagtgctaccaaacagcatcacatttctaaagagaaatcttttgtgaaagtgtgacgtggcacacttttattgttgtcttattttaagaaatggtatataaaaatgtacatgctataaaagccaacccaaccttcagcaatcactattctgattagtcagcagccatcaacatcaagccaagacccttcaccagcaaaaagattatgacttgcttaaggcttggatgatcattagtattttccagcaataaagtattttaaattaaggcatgtacattttttagacataatgctattacacatttaatagagtacagtgcagtgtaaacattacctttatatgcactgggaaaccaaaacatttttgtgactcactttattgcaatatttgcttcattatggtggtctgaaattgcacccacaatatctctggggtatgcctgtatttatctaaagacaacaaaatcagtatgttgtagagatatttgcactcccattattattgcagcactattcacaatagccaacatagagaatcaaactaagtgcccatcagcagatcaatgaataaataaaatgtggtttatatacacaatggaatactattcagccatttaaaaagaatgaaatcctatcatttacagcaacatagatagacctagaggacattatgttaagttgaataagccaggcacagaaagataaatattacatgatgcattagtccattttcatgctgctgttaaagaaatacctgagactgggcgatttacaaacgaaagaggcttataatggacttaccattccacgtggctggggaagcttcacaatcatggtggaaggcaaggaggagcaggtcatgtcttacatggatggcagcaggcaaaaagagaatgaggaagacactgcagatgacatgattatatatctagaaaaccccattgtctcagcccaaaatctccttaagctgataagcaatttcagcaaagtctcaggatacaaaatcaatgtacaaaaatcacaagcattcttatacaccaataacagtcaaacagagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgctcatgggtaggaaaaatcaatatcgtgaaaatggccatacttcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagatcaatgggaacagaacagagccctcagaaataacaccacatatctacaactatctgatctttgacaaacctgagaaaaacaagcaatggggaaaggattccctatttaataaatggtgctgggaaaactggctagccatatgtagaaagctgaaactggattccttccttacaccttatacaaaaatcaattcaagatggattaaagacttaaacgttagacctcaaaccataaaaaccctagaagaaaacctaggcattaccattcaggacataggcatgggcaaggacttcatgtctaaaacaccaaaagcaatggcaacaaaagccaaaattgacacatgggatctaattaaactaaagagcttctgcacagcaaaagaaactaccatcagagtgagcaggcaacctacaaaatgggagaatatttttgcaccctactcatctgacaaagggctaatatccagaatctacaattaagtcaaacacatttacaagaaaaaaacaaagaatcccatcaaaaagtgggcaaaggacatgaacagacacttctcaaaagaagacatttatgcagccaaaaaacacatgaaaaagtgctcatcatcactggctatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaacccttgtggaagtcagtgtggtgattcctcagggatctagaactagaaataccatttgacccagccatcccattactgggtatatacccaaaggactataaatcatgctgcataaagacacatgcacatgtatgtttattgcggcactattcacaatagcaaagacttggaaccaacctaaatgtccaacaatgatagaccagattaagaaaatgttgcacatatacagcatggaatactatgcagccataaaaaaggatgagttcatgtcctttttagggacatggatgaaattggaaatcatcattctcagtaaactattgcaaggacaaaaaaccaaacactgcatgttctcactcataggtgggaattgaacaatgagaacacacggacacaggaaggggaacatcacactctggggactgttgtggggtgggggaagggaggagggctatcattaggagatatacctaatgctagatgacgagttaatgggtgcagcacaccagcatggcacatgtatacatatgtaactaacctgcacattgtgcacatgtaccctaaaacttaaagtataataataataaaataaaaaaagagagaatgaggaagacacaaaagtggaaatcccttaaaaaacccatcggattttgtgagacttattcactgctattagaacgtatgggggaaaccacctccatgattcagatatctcccatcaggtccctcccacaacacatgggaattatgggagtacaattcaagatgagatttgggtgggggcacagccaaaccatgtcattccacccctggcccctgccaaatctcatgttttcacattttacaaccaatcatgccttcccaaccattcctccaaaagtcttaactcattccaacattaactcaaaagtccacagtccaaagtctcatctaagacaaggcaagtcccttctgcctataagcctgtaaaatcaaaagcaagctaattatttcctagatacaatggggatacagacattgggtagatacaaccattacaaatgagagaaatttgacaaaacaaaggggccacagggcccatgcaagtctgaaatccagtggggtggtcaaatcttaaagctccaagatgatctcctttgactccgtgtctcacatccaggtcatactgatgcaagaggtaggttcccacagtcttgggcagctctgcccctgtggctctgcagggtacagcctccctcctggctgctttcatggcctggtgttgagtgtctgcagcttttccaggggcacaatgcgagctgttggtggatctaccattccggggtctgggggatggtggccctcttctcacagctccactatgtggtgccccagtagggactctgtgtaggggctctgacctcacatttcccttctgcactgccctagcagaggttctccatgagatccctgctgctgcagcaaacttctgcctgggcatccaggcatttccatacatcttctaaaatctaggtggaggttcccaaacctcaagtcttgacttttgtgcacccacaggcttaacactatgtggaagctgccaaggcttggggcttgcaccatctgaagccacggcctgagctctatgttggctcctttcagccatggctagagcggctgggacacaaagcaccaagtccctaggctgcacacagctcagggaccctgggcccagcccatgaacccactttttcctcctaggcctccaggcctgagatgggaggggctgccaagaagacctctgacatgccctggagacattttccctattgtcttggggattaatattcagcttctcattacttatgcaaatttctgcagccagcttgaatttcttctcagaaaatgagattttcttttctattgcattgtcaggctgcaaattttcccaacttttatgcactattttcatttaaaaactgaatgcctttaacagtacttgagtcacctcctgaatgttttgctgcttagaaatttcttccaccagataccctaaatcgtctctctcaagttcgaagttccacaaatctctaggttaggggcaaaatgccaccagtctttttgctaaaacataacaagattcacctttactccagttcccaataagttccccatctccatctgagaccacctcagcctggatttcattgtccatatcattatcagcattttgggcaaagccattcaacaagtctctagggagttccacactttcccacattttcctgtattcttctgagccctctaaactgtttcaacctctgcctgttacccagttccaaagtcgttcccacattttcaggtatcttttcagcaacaacccactctactgttaccaatttactgtattagttcattttcacactgctgataaagacatacctgagactgggcaatttacaaaagaagaggtttataatggactttacagttccatatggctggggaagcctcacaatcatggcggaaagcaaggaggagaaagtcacatcttacgtggttggcagcaggcaaaaagaatggggaagatacaaaagtggagaccactgataaaaccatcaggtctagtgagacttattcattaccatgagaagagtatgggggaaactgcccccatgattcaattatctctcactgggtccctcccacaatatgtgggaattatgagagtacaattcaagatgagatttggatgggaacacagagccaaaccatatcacatgatgtcattcatttgtggaatcttaaaaagatgatattacagaagtggaaaagtaattaccagaggctggggactgtagtgggaaggaggatagggatggattatgcaataggtacaaaattacagttagataggagaaataatttctgctgttctatagcacagtagggttgacaatactgttataactagaacaaataactagaagagaggattctgaaagttcttaccacaaagagatgataaatgatgtgatggatatactaaataaccttatttggtcattatacaatgtatacatgtatggcaacaacacattttacctcaaaaatatgtacaataattgtgtcaattaaaaagcaaataaacttacaaaaataaaataaaaagggacgtgcaatctcaaaacttacaaagataagtatataaactcaaattaagttttagtgaatcctaaatatttacaaagttttcaaatgattcagccttttaaaaatctggaagagtttttcttctttcctagtaagaatctaaaagaaggaaagtcacatttatattttatcttattctttgaatcactatttaccacctacaagagaaaaaagcaacataataaactaggactatgaaccatgaaaaaagaattcagatgtttgaaaattgttcttccagaacaatggtaaaactaaaagcaatttttgatttcacgaacatttgcaactttagttacactaattactagttgacaggattttaaggaatgcatttaacttaataataccctcaaacagaaaaacattttgcaaacggtaatttcagtctattagctatttacggcaagtcttatccagcttggcaaatatttgagtgcctactaatggttcaaaagtggtactgcaccataaagcctcatctggtctaaagctggggaaattgaagggtcctgtgtacttgatttagagtctacaataaccaaccaactctctgttttctgtctttaaaaaactgaatcacttggggaaaataggaaaataaaatttagtaggtattattttaaaaaatacaacttacaaataccatttccgttttcttgaaaacaaagcttcctttctgcaagaaacaatgacaggtaaatgtgaagtgagctgaagtatgctgtaaggaccgtggatatggagacaaaacaccagtgttctcatcctaatactgtcacattctatgtgttggtttccacatctaaaatgagggtttttctggctttaaaattatgaccatagaaaaatttcctcagtcagtaatgattaaacttccaaaaatataaataaagtgattgttttcattttgcagcattttataacagaaattatagctaacaaaagttaacagaggacttgactatttgtggatttttattttcttctttaaattcttggttttgttctgaactttcatagtaggcatagattactcttacattcataaaatgggtttctttttcaagtttgaaaaagaaataagtgaaccatagttctttcagtagtataggttacatggtatatgttaaaattttcctccccattcaatcccagcaataaagtacatatactagtaatagtcatttaggccatcacagagatatgttgcatttttaatgtggttgattggtgtttcttttaataagaataaatttaaaatggaacttttttttttttttcatttcaaagcatcttgatataacaggaagagaatgggtttttccatccctgtatatctagtcaagaatcccatcccttctgcttcccaactgtgactttgggcaagttggccaacatttctgaagatgagtagggctactgtatgggattactggcaaatggtctctcttctgtattccattctggggtggtgagtctgaggctctggaaacttcatgtcctaggtttccttgccagctggattccagtatggtttcatcaatgggagccattggctggtgattggcaggtttctagattctttcagcatctgcctagttgcaaatgacaactccagctccagctccagtttccagtttctctaagtactctcagtcccagctgcactaagttcagaatagcagctagctgttctgcatcaattggtccaagcactccacagtgtgggccccagaggtatcagcatcagccacactgcacatctcctgctctatgttctccctcaaaaagccaagcactatagggctgggccttcacctgaggggttcaagcatcagttctggaaatggaggagggggtctctcctttgatcccctgggttctaacaatttaattgtgcccttcttttacccagtgtgaatgcctactagtctaaccatatagctaagaaacccctttcttcatttatccttgcagtggttttgtatcaaatttgtgccttagcaaaccacctattttaaccctttgggttgcttaggagttgtccaaatggtgcattttaaagtcgaccatgtcatggatctattgtatttcttaaaactgttaataaaagatcagtcaataaacctgattacatctgcacatctgcaaagagtgtttcaaagtctgaaaattcctttatcctctgtaaaggcaatttaaccccaggaagttccacgtcctaagcaggtaagtttccagttgatcaaagaactgatttctcccaaataaaattttagtctttcctccaaaccactcacttttgactccttacaccttcattccatttttttcttttgggtggaggtggggaagcaaataaactgtagtaatacaaattgttactttaaaaaagacctctactttaaagttccctacagtcccttaaaattttttcagtcagtaggtactctctccaagataatgctcaaagtactaagtctttttattcatacattcaacttttagttgtgacatggcattatcactgatgtgatatatacatgacatatacaacttctctctctaggtaagaaaaagaatacaacatatttctagcatttcctgacagattcaataatcagcaagtaaaagaaatcccatcaacccataagtttgttattagtcaatataggcttttgatggatgaagtcattttgggaaatttcctaaattctaaggtgtacagaaggaggataactggatctcaattgtcctctgagtcctatgcttctctggatcaattttagagaacacaaagttttagtgtctttttccacttcgatcactttaaatcagaaggagtacctggatgaaacaaaaatgagttttcccaacttccatattgactacatgtgctccggcagtatcacaagtgttgagcttctttgtcacacaaaagtttcaggattaccttgtcatgctcatttaaatgtatgatggattgatttgtctcgcttcacttttctctcctactgtttgaggttcctgggaggagttgtttggagtgaagggagaaggggatggtctgaaaagctttgaggtctatctggaaacaactttagatgtgtaaattctgcagagcttaaggcttctcatgccttatgatagagacagttctctcaacacatcatgattggtcctggctggccctagaggaaatgcagtcctttcagggtgtgtaggatgaggtgctattgctggggcaacgcattggagtctaattgcaggagttaaattactacctggaaaccggaggagagctgtgaaaggaaattgtggtggcatctgatcctgaaccagctaagttttgaggctttaagaggaggtagttttcaagcagaaagtgaaaaaaccattttcaaaagagacttggtgagactcagagcacaagaggtaatgctcatgtccaggtacaaagttatgctgagagtgggaagacaatcaccttgacacaaaccacagagtagctcaggtacagtgaggattgaagggataaagcactgttttgtgcttaaccttaaggttttgccattttagcaattgaaggtgattatactttgggctgtttctgaagacaatatccaggaggatccaccatggggatgtgaccaaacacaggggatgactacatagctgggcgaatgaccagaggacaaggcagcatggcccatgctgagagagaagcagcaccctgtttagggtgtaagtcattcctgggggacaagtgtgctgggagctagtgctttccaattagacacatgaaggctaccaaatatatacccacagactgattgaaagtggacattttcagattacaccttacttatatatttaactttatattactattatatgttaaacctcacatgtatccctaaaatgaagttaccaaatgtttgacttgcaaaatattttccaatctaaaagccatagttttcattgtttcatcaagaccattgttcttgggatacctagttaaaatgtcttaattcagtcttcttatctttgtggttttccaatgctaccaaactaagactccagataaaaaccattttcctttgcaatgactaaagtcaaacatcttagatttttctatccaaatcattaccctatttaccatcacatttcagttctggatatgtctgaaagtaaaaataaaaatgttttctatatcacaagaaagcatatttgaataggaacttccggttaaccacagtttctattctacttctattaaaagaaataagcaaatgcaggaagaaagacttctaaagaaatattttagatctcctctggcactttgtatcttgatgaattgcgcatttactccaattgggcttttctgcttggttttgctgtgtgcattttgatggcgaaatctaaaaccgtgtggctgctgcactaacgtggtttactgccaagcagctggaccattataacggaaactctgagcttgtgagacacaaccactttttaaaaaaaatttaatttacctttagaatcatgtcttatttttcagcaagaagttgtctttatatttcccactaatttcagaggaaacactgacaagttaaattttagcaattttaattaattaatcaaaacaaataaggtgattgtatagttggttctatttggctttcagctgtccatagagatgattaaacgttttggcaaaagtacaaaagctcagcagaatttgatagaccaactcttttctccactaatggacatggatgatacatagtctgggaaaggagaaagataaactgtttttgacagtggattaagggcagacctctgccatgacctagaaaagacagtgctaagatgaactctcccttaagtttttgaagggaacttaatcctacctctttccagaatgactattttatcttctttatttctgcctggctgggcttagtgttccattgaccttactcttcctgttggatgtgcagaacttcctccagcattcagaaaagtggggatgtggctctggaagaatgtgagggtaacactatggtatagtaagtaatgcaggcccaagaacaggtaatttaaaggcaatcctgttttaaaattactccagatgacagaatgtgtacctagggtctgcaaggaaattcatcaaacctcagggacagaaggactatatctttaacccaaagaggatgttatctgagccatctcagtaagaaaaaaacccaaatctttcattagaagactgccagagaaggcaagccatgtctacctcattctagtaccctggaaatacaccactctgtcagctatgatggtgtccctgagtactttctccagttttctagccaaaccactcttaagctcaccaaatctcatcctcactttactactgttgacatttctagggcctagcaaacagtagaatatttcaagttacagaatgttctttgccaagagcaagcaagaattctgaactgctcatatatcagcagtcagcactttccaaaattgaaacaactgttttttttgattgataatgggctacacttttccctcaaaaaatagaaaataaaatacgtatcataaaatgactgtaattgcttgtaactactcatttttaattcaaatactatctcaacttgaagatcctccctcttacctaccatcatttggattggtaacttcaatttatagttacactcttactttatagaacatcacagttagagatgttattcttttaggaaataatttcacagcactgtttctcacattctacaagtttttagtcaacagtggcattatactctctatagctacagagaaaaaaattaatccttaaagagctaacaaattttcattccaagctaattgagtccctcttttcaggcacctaaaagtccctcacagactagaacaactctagctccccataaagggaatcttatgctctatgctctacttgctcttgactacaacattttaatgacaatcttctatgaaagtgaaaacacttttctgaatgtatgcatgtcccagggttcagatgacccattctaaaatcccaccttcctatttttggagaaactgaaaaagtacaaaataactgaagatgaagaaaataactcaattcagaacatgttgctaaatcccttgtcattgatggtgtagacaaggacaatggcttgagattatctccttccaacatcctattcagatgtacacatttacactctagcaagcacctggagtaatttctaaataattttatcatatcttaaataaactttctatttaatctaaatatggttattattttgaaggtttgccagtgataaacactgtagaaataaacacatagagactaaagttaaacagagttattttaccagagctgaagaggaatgcttaggtagactaacattatccttccaaagatgttcgtatgtaaagaatgaatactttacatatcggtagccagttttcccaacatcatttattaaatagggaattatttccccatttcttgtttttgtcaggtttatcaaatatcagatggttgtagatgtgtggtattatttctgagggctctgttctgttccattggtctatatctctgttttgataccagtaccatgctgttttggttactgtagccttgtagtatagtttgaagtcaggtagcgtgatgtagaaagctgaaactggatcccttccttacaccttatacaaaaattaattcaagatggattaaagatttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgtaagctactcatctgacaaagggctaatatccagaatctacaatgaactcaaacaaatttacaagaaaaaaccaaacaaccccatcaaaaagtgggcaaagaatatgaacagacacttctcaaaagaagacatttatgcagccaacagatacatgaaaaaatgctcatcatcactggccatcagagaaatgcaaatcaaaaccacaatgagataccatctcacaccagttagaatggtgatcattaaaaagtcaggaaacaaaggtgctggagaggatgtggagaaataggaagacttttacactgttggtgggactgtaaactagttcaaccattgtggaagacagtgtggcgattcctcaaggatgtagaactagaaataccatttgacccagccatcccattactgggtatatacccaaaggattataaatcatgctgctataaagacacatgcacacgtatgtttattgtggcactattcacaatagcaaaggctcggaaccaacccaaatgcccatcaatgatagactggattaagaaaatgtggcacatatacaccatggaatactatgcagccataaaaaaggatgagttcatgtcctttgtagggatatggacgcagctggaaaccatcattctcagcaaactatcgtacgaacaaaaaaacaaacactgcaggttctcactcataggtgggaattgaacaatgagaacgcttggacacaggaaggggaacatcacacaccggggcctgttgtggggtggggggagggaaagcattaggagatatacccaatgtaaatgatgagttaatgggtgcagcacaacaacatggcacatgtatacataagtaagaaacctgcacattgtgcacatataccctagaacttaaagtacaataaaaaaataaaaataaataaaaataaaaaaatatagaagtgaaacatatagtcagtaggaggcttctatgggcttctcccttgctggaggaagccaaaataataaacagttttacattcctagtgccaggacctgtgtcgggtcaacaaaatctgagacaagtcaaggtaacagaggcagctgtttgaatagattcactggagagtctaaggcagctctccagaccaagctgtataggagataagatagaaataatcactccggtaccactgtaggcaggacttgaatgtactggggcccttttaatcagacttagcaagcattttttgcctctgatcttctagttggaacaaaattagttaccaatagacttaggcaaatgctatgctgtaggcacatagccccaatctatataaggactaagaaaattttaacactttgagttggtctggtggaattacttctggcctcctcactgtatccagttacagtaataaattcccctcttcctagtttgtctgcttctcattattgggacttgagaaaacgcagccagacccggcttcgttccaggaacactagtaggaatgtaaaatggtataaccactctgaaaaacaatttgacaggttcttaaacagttacacaaacactaccatatgatccagccattctattcttaggtattttaccaagggaaaagaaagcatatgtctacacaaacactgtacattgatgttcataacaaattaatttatgataatcaaaagctgcaaacaacccagctgtccatcaacaggtgaatgaataaacaaactagtatatctgcacaatggaattctcctcaaaaagaaaaaaaacaaaaagaatgaatacactcctgagctatctgtctttgcattattgctaatttatgaaaagaaaaaataaattgtcataatttatagccccatttccattctcacaaggttctagcttccaccacatgatttacagccctttatccatagtgtgatcaatcaagtactaccaagaccaaatttcctttcccaggtatctatttagtcacttctctggctcttactctaattaacatgtttctagattgacttttcaatggttcacaacttgccacttaatatttatgggctatggcttctcattttagaaaaatatattccctctttaacaattccctcttaaacaagtaacaagcttactggtgtgagcaatcacctgcccttgtagggtggggcctctccataggctttaccattgccagttggctttttttctgggttctgcatatgttttacagagtaagactctggtgctaattctgaataactgagaaccttattcacctctccaattctatgatccaaatgcttccatttccgtctacagtctagtccacaacctcttctcaatgaggactgtgtctgtctcctgtctcgcagcagggctccagtatgaaccatgctgtatagaatgcatgaaacagcagcctgtggagcaactgagagctgtctctctcctccttacatttgccgttaaagagcacatgagtagtagctgcattaaagcagtgggaaaatccctgacccactttcccacctttcccttacttctacatcacacagccggaaacaaagttcggggagaagagagcatgaggaatgtacttcaaaagcatgtccacatcacacttgcacagcttctctccacatctgtgcttcttctgctctattttttgatacgataaggaatgtaccatcagcagaaaatggtgggtggttttaaatctatcatcaccttttcacataggagagaaccaaggtgcaaatggcattatacacattgtccctaagtttgggaaactggtgagcaataaagttggattaagtaaatgaatgattgggttgtgtcaacaccaagcccatgattctactgttcctcaaggaatgcttcagaccctatgttcactcaaaagtggcatgtgtattgaagtttagcttttctccttttcttcagcaaccaactagaccctcccaatcagccctgccccaggtcaggacataggacatgcaggggcatttagagggtattagaaaaaagaataatgatattggaagtatggggaggctgatgaagggaaaatgagtataacatgtttctagtacattcttctttctcttttaccatatgctctttcctgccacatagttcagaagggtaggatttgcacggaaactgtcaaaagttgcttctgatttgagcctaagtgttaaggtctattttgccatttctagcataaaccaaacagaggttttaaaatggcatgcttgggaaaccgtgggcttctatggttgtattgaaggatcaatacaagagactcaaatgcaatgcaaataatttcacagcattaaagaaggacaatggcacaatggatgaaaattggtaaatatcagaaacctgtactcaagttagagaatattttattaattcaagcaagagatactaagaacttggaatcagccaacggtaatgtcaatgaaaaggaaatagcaagtatgacaggaactttgtgggcagaaccaactagaattagtatttcataagttgtggaagattaaggaaaatgaggagttggaaatggcttcaagatttccagccaggagactagaaggatgtttatggcattaactaagagaggagcttggtgaaaaggaaaagatgtgaagaaataatattgtaggtggagaaaatgttgggttggatttataatatgtttcaagtataaataaaagcatgaacaaacgaacaatatgctccaagtttgtcaagaaacttaaagattgtcattttaatctttttcttgctgaaatttatagtcttaccaaaacccagttcttattgggagattaatgactaaatatatattaaactttctttctctaaaactctgttcctctctgtgggagataacaaccagcaaattatgaccatgaatcaagaaacctgtaatcaaatagttcataactatgaacagttcataaacaaatcacggcttctttgaagcagactgtagattcacacttctctaatagcctctaattttgagcaaataagttagtatgtataattttccacattattcaataaacttgtaatgataaaccattagaataattatgttcaccattttcataccaacaaaatgtccaaaagattagggcagacacacttggagaaggaagaatattccttatatcatgttcatatttaaatttcctttaaaaacttacttgttgtactcaaaatatataactttacaagattgtataatctttaaaagtaaaatccagcatattttagtgatctgaagccatagtcaatttcagactttcgcaacaatgattattctgcttttggataaagtgagcaagtattttcctaataagctaaagtgacagtttaagtgctcctcttagtaagcttcatgtttaattcccatgaaaggtttatggaaggttctcccctataaaactagtatattatatttaaatttcaattatatgacaagttacactcatttaacctttcatgcaagatttctgctctctgagttatagtttttctgcttcttccaagtgataataatttcttgtaagcttaaaggcaaaaatcactattcacccaaagccaaaagaaagaaaggtaaaagacctgtaaaaggcctttttatttcataacctagatcaatccatcattcatgtattcatttatgtatttgtgtaccaagtatctattgagtatctccatgtacaattactgtgacagataattgcatttacaaagttgaccaacataggccctctcttaaagtttagtaagggatgtagacatgtaaactaacaaatattgaatgatcacagcaatgatggaatgacttaccaggtgatgtggaaacacagaggatggagggcgatctataccagaatggaggaagtcagagaaaactttcaaaaaggctaagcctcaggtgagtcttgaaggatgaatgaagcccttgtctctttaacaactatgcttgaataaaatataaagatgccaaatgctatgattgaaagggccctggagacccttccttataaacataatccctgctaacatgcctccttgtaagtcattttatattaagtctctgcctgaggaagaccattgtcagatgaaaattctttaactagaaaggttaacacaggaataaacagccatccatatatttacacatatacttcatctatttctcagcaatgggctagatgaagaaatgggattctaagtagagatatttggcagcagggagcaagaagagccaaaatcccatagaattctatgaagggcagatcccagtgggggtacagccatggggttcaacagacactagattcttggcagagttgtgactacaggtggatgaggaatagagcagccctcaagagaagaagagggagaagtggaccaactcactcataatttctcctcatgttaaatcttccatttcccagggagggagcagaaaacacttgatagtttagatctcctcaaattagaaggaagccaatccagtgagcaaaagccaaaaggcaaagcttgggcttcagtttttgtttgtaattgaaaaggcaccaaaaaatagccactgagctgtcaaaaggaatgtgaaggtcagaatcatgtttaactgcaaatacaaatcaaatatacagagttgactccaagctggctgagaagataggaaactgacacctattcagcccacatacattgaaaagcaagcagtggtagccttgcctataacaaagatactgtaagaaatcctggctttttaaaaaattttattattattttatttttttaaaaaaacatgctgagaacctgcactcccaggaaaatgaagtatatgtaaatttctctattcctccctggaataaaaccctggagatgatacacggacagatgatagatagataagaactctgaaagatgcggggaagaagacagactagctagagacctcaggacctcctggcaaaaaaacagtggtaaatcccttgagttttctttttgcttcatatatcccagagtagaagttgaagaagccagcaacacagaaaaaacaatgggcacagatcagaatgagccccaggaaaagcctactctctctaaccaaaggaccaggaaagaagctgtgatggttaacactgagtgtcaacttgattggattgaaggatgcaatattgatcctgggtgtctgttagggcgttgccaaaggagattaacatttgagtcagtgggctggggaaggcagatccacccttaatcaggtgggcaccatctaatcagccgccagtaaatacaaagctggcagaaaaacgtgaagtgatgatacggtcctagcctcccaatctacatgtttctcccatgctggatgcttcctgccctcgaacatcagactccaagttcttcagttttgggactcggactggctctccttgctcctcagcttgcagacagcatattgtgggaccttgtgattgtgtaagttcgtacttaatgaatacttaataaacatgaatatatataaaataaacatttatacatatatatacatatatatgtgtgtgtgtgtacatatatatatgtacgtatagtccgtactgactaatacggaagcctagcaaaaagaaaatcttttagaaaaaattaccccactgctcaaacaccccaaataaaatggtggacccaccctcatccaggccagcaaaggctaaatgaggagcctatgcttccaccaccaccaagctataaggaggcatcccaacctaccccgactctcatcagggtgttgtcagggagagctgaataaagaggcagaacttttatccccacagggcagtgccaagattcactccccatcatcacacctgctcactcccaccttaccctactctctgtactttcctcctgatgaggagcagcaaccagcagggaaacctaaatttctacctcttctcagcagcattacaaggagtaaagacagcagacacaaattaccaatatcatgaatgaaacagaggatgtcactatagactctaaagacaacaaaagggttaggagggtatactacagatgactctacacacatacatttgaaagcttagataaaatgaacaattcctcaaaaaacagaaacaatcacatctcacccagcatgaaatagataatttgagtaattctatggttattaaagaatttaaatttgtaagttaaaattttccagaggggctgagagcagtggctcacacctgtaatcccagcattttggagggccaaggctggtggatcacttgaggccaggagttcacgactagcctggccatcatggtgaaaccccatctctactaaaaatacaaaaattagctgggtgtggtggcaggcacccataatcccagctactcaggagactgaggcaatagactcgctaggaggcagatgttgcagtgagccgagatcgcaccattgaactccagcctgggcaacagagtgagatttcaaaaaaaaaaaaaaaaaaatccaaaagaaaaaataaaaccaaatctatgtaatctctcccagagaagggaagcaaagagaatgcttcctaattcattttatgaagctggtattaccctgataccaaaatcagacaaaaacattaaaaaagagagaaaactactgaccaatattcctcataaatattgatgcaaacattattaggaaaatattagccgatggattttggccatatacaatgagaattatataccatgaccagggagtttattccaggaaagcaaggttggctcactagttgaaaatcaaagtaaccaccatcttaacagattaaagaaggaaatcacgtttgtgtcaagaaatacagaaaaattatttaacaaaattcagcacacattcatgagaaaaacccagaaaaactgtaatagaggagaactttctcagcttcataaagagtatcttcaaacaacctacagctaacattatactgaatgctttcattctaaaatcagcaacaaggctaagatgtccactctcttcttattcagtatagcactggaagttctagcaagaaaagaaagaacaaataaaaggagtagaaataaaagtcctatagataggaaaggaggaagtccaactgcccctatttgcaggtaacatgaatatctgcatgaaagttccaaggaatatataaaaatacttttagaactaataaagtgagttcagcagggtcccacaatacaagataaaatataaaaatcagactttatatattaaaaaaccacataatgaaccatagacttaaatgtaaaactataaaaatgttagaaaaacacaggagacaatctttgagatctagggctaagcaaagagtgtttagatttaacaccaaaagcatggtccattaaaaaaaactgataaactgtacttgatcaaaatgaaaaacttttttttctgcaaaaacctctcttaaggtgattaaaaaacaagcttcaagctgaaagaaaaattgcaaaccacatatctagcaagatactagtatctagaatagataaagatttctcaaatctcaatagtaaaaaaaaaaatccattaaaaattgggcaaaacacagaagagatttgaccagaaaggatatacagatacaaataagcacatgaaaagatgtcaaaaccattagccattaaggaaattaaaattgcactgaaatatcattacataactatcagaatggctaaaataaaaaatagtgacaacacaaaattcagaaaagatagagaaactgaatgactcattgctggcaggaatgtaaagtggtacaatcactctagaaaacagttttgtagtttctaaaaaactaaaaatgtaattttcatatgatccagtaatttcactcctaagcatttattccagataaataaaaacttaagttcacatgaaaacccacacatgaacattcataacagctgtatccatgatagccaaaattggaagcaatctagatgtccttcaacaaatgaatggttgaaaaactgtggtatattcatacgaaggaaaactattcagatacattcaacaacctgaataaatttctagatacttatgctgagtgaaaaagccaattctaaggttataatcagtttaattccatttatataggatttttgacaggacaaaattatagacatgaaaacaaattagtgattgccaggaggtaaggaggaggtgagagtgagagggaagtgagcatgtctgtaaaagagcaataggagggatccttgtggtgatgaagacatcctgtatcttgactatatcaatgtcaatctcatgcctgtggtactatagttttgcaagatgttgccattggggaaaactgggtaaaggctaaagatgatccctctgtattatttcttacaacttcgtgctaatctacaattatctcaaaatagaaaatttaattaaaaagtcaaaacaaaagtgtgctgtttctctgcctaaggggattggagaaattacacgggggcccagaaaataagaaagcaagagcccactcaatcctggctaaggaattagaaacaaagaagaaactaggaagcaagacaagatttccttcttatgactcggtagagctgacagttgagcccgacgtggaaggttaggtggttgggttatggtcaactgccatttgccatatgctcactgtattagtcagggttttgtacaaaaccagcaagatgtgtacatagacagagacatttattttaaggaggtgtgtgtgtgtgtgtgtgtgtgtgtgtgtgcattcaagcaagtcaagttttaaaaactaggaaaaaaaaccatgactcacctggtgggaaaagatagttataaccatcagacaaggcatcctatgcttccatgctgtctttaacactagcagaaaaagtaacttaaaaactctgctgcaagatgactggctgttttctaaactatctgaagttctctcaggccatctgtgggataactccattttattttctcttctataaatattttaggtgtaatctcacatgccacaatttgtttgtcacatgtgtcacctgggtatgatggtttgattcataaatttctcttattctctgctaattttcctctctctcctgttcacccccaaatctcaagcttctcttttaactcataagacattttaaagatccatgatctaagccagagaggctggtctaattgaacagcattgtcaaaaaaagggctaatattatatctccaaaaaattacatagtttttattattagaatgcttttctccatatgatactttaaaatcagagttgtttacattttcttatatatttacatattttaacacttcaagactttaaaaagtttgagcttagaatggactcacttgaaatgcttctgtaaattaaacacaatatgaaataaatacaccctgaaatgtcatgatggctttgttcacctttgcatttggttgaagagactgaacacaaaaatctgaagcagagcattgcttttggaacatagcttacttggtccaaattgccaggagtgcaccaacacgtacaagactcttaatgcaaaccaggaacagatggcctatcctgacagaaaaattacacacagaggccccttcctctgcacggcctcttggagctggaagtaacttgtaggtgttggtcctggaggaaaggaagattttccatttttgagggctgaatgggtggtaggatgcagcaaatctttcactacttcttgagaaaaaagtcacatacgctagacccttaaatattctggtccagtacactttgaagtttctcacccagcatcacatatcatcatcctgaacatgtccttgttagtttctctatccagttttacatgctcattttggtcctttccaccgcaccccccttccgaaatagttcttccacacttatcatggttctactacacttatcatggtgctacttcttcatgtggtgttatcccctccctgtgtgctcagctttgccagtctttctaagctgtctattggccttttctgtatctttccctgtgggttagattttcaaggccattggtcatgtctgctacttatctctgaactccttccattttgcctacacttctcaggtagtgagctgctcaccagagtataacagaaggaacacacagtctcccaagattatgatggaattcttggggtatgctatttagtaattttaaaaaattaatttcccatttaagatttgaatataattttatgtctatgaataactttagttgtatttcttctccctggatctatctttctagttcaagaagttattcgtgaaagtatttctccaactgtattagctttagtttttagaaagtgtcctattatttgtatcatttactttttttcttttttctttttttttttttttgaggcagagtctcactctgtcacccaggctggagtgcagtcatgcaatcttggctcactgcaacctccgcctcttaggcttaagccatcctcccacctcagcctcctgagtagctgggaatacaggtgggtgccatcaggcctggctaatgtttgtatttttagtagagatggagttttgccatgttgcccaggctggtctcaaattcctgagctcaagtggtctgcttgcctgggcctcccaaagtgctaggattacaggcatgaaccaccgtgcctgtaaaattaaaattttttaaaattatcttttaaaggtaatttttgtcctaattcaagattgataaatatcatgttcaatatcctaaaatgaacaatttacaattttttgtaaaaacatgtaaagatgtaaaaatacatctttaaaaagatgtatttttcaacctgaacctgaccaaaaattttgcataaatgaaaattaaaaagtactttttaaaatgcaaaatctttcaagtaccctattagaaatctgtttagagaatgccaaactaaatctatttacataacaaatccctacaaattgctttttaaaagcaggattaaggtgcattataattaaccttttgctttaacacagcatcaaaataacaaagtactttgcaaattacgtagttttctagtttgtcaggggaaaaatgttctcaagtgtgtcttatataagaatgattattccagactatttgaattatagaagtacatataattttagaatttttaggaaatgtgaagtaagcaataaaaagaatcttcaaataatattattaattcaaatgtatatattcatagcaattttttttttaagaataagacatatcactctatgtgaggtagtaaataccaaaacaaacaaaattcactggttttgtcaaagaacaaaataaaaccaatcaaaacaaaactcttcttgtccatccaggcagctgaggaaggcaggaaggcaggtaaggtcagttcactgaaaatcaaatgttttaccaaaagcaaagaaccatttattaaaaaaagtcttgtgaccaccaaaagaactaccataaacaagaagctgtcatggccacgtgtgcctgtaatcctagcactttgggaggccaaggtgggcagataactagagctgaggagttcaagggcaccctgggcaacatggggaggattatgccatgttgtgtgtgtgtgtgtgtgtgtgtgtgtgtgtgtgtgtgtgtgtctcgagcagattctggctgccccagactcactaatgctgcctcctggttgtatgttctccaggagatagttttggatccttcatctattataaaatgcattttgtgtgattttcttccttttgcattatattgcatgttatcaatttaaggaaataatcctttggaattgttaaaaaaacaaataggaagctgtgatgtgacaatgaaaaattgctgggtcttaaaacatttgtaaattgtggattttaggatattgaacatgatatttatcaaccttgaataaggacaaaaattattcatagaagagagaatacactaaacaaatgttgtctacttgtatctgacaggaaaggttttcctctttttaaaaagataaatcataggtccagccctgccaaagagcaacactgaatcattgcacgtaactgaagcattgacttgtttttcacctgaaagttttcagaatatgctatgtttattaccaaatggtagagcaggtataataaaaatagacaccaaccatcctcctaggaaagacttgagtagaaagtaatgtgattctcaatgcctttcacacaaaagacacatatggtaattagtttattctcctcatgtacggtgtaaatagcaaaatgtgactgagtggttattgtaggcactctttccttagaaagagtttcattagagtttgaaagtatttctgggaaaacatcaagcaaaatattccatgttgctaactgtaatgtatgtaaatggggttttccaccttttggtgactcatcttgacttgatccttaatcagaattagaaaattcctaaatttatatgtggaggaaagatgctttggggctcccctccccagtaaactaatacttaatgtaatcccgacttcagaattgttatcaaccaggggtcttagttggtcctgaaagatctaacttgtgttgtaataggactgggactatgaggaataagatgtaggatccagaaaaggaagattttctggactgacataaatatctaaaatacctgaatgttgtacttcaaaagtaacttgaagcaatttttagtgaaacataccgacatatttaaaaaataaatcagacatatatgaggagggaaaaaactctaccaggtttcatttcccagagaattactgatataatacaaaagcatttgtctaatcttcctggcagctgaagaggaaaggcaaatagggcatgttatttccacaccccgacctcgtatttctgcgccccgaccccttctctgcttttctggagggcaagaaccccccaccccttctccatgtctctactcttttctctgggcttgcctccttcactatgggcaagcttccaccttccattcctccttcttctcccttagcctgtgttcttaagaacttaaaacctcttcaactctcacctgacctaaaatctaagcgtcttattttcttctgcaatgccccttgaccccagtacaaactcgacagtagttctaaatagccagaaaacagcactttcaatttttccatcctacaagatctaaataattcttgtcgtaaaatgggcaaatggtctgaggtgcctgacgtccaggcattcttttacacattggtctctccctagtctctgtgcccagtgggactcgtcccaaatcttccttctttccctcctgcctgtcccctcagtcccaaccccaagcgtcgctgagtctttctaatcttccttttctacagacccacctgacctctcccctcctccccaggctgctccttgccaggccgagctaggttccaattcttcctcagcctgtctccaccctataatctttttatcacctcccctcctcacacctggtccggcttacagtttcgttcggtgactagccctcccccacctggccaggaatttactcttaaaaaggtggctggagctaaaggcatagtcaaggttaatactcctttttctttatcccaaatcagacagcatttaggctctttttcatcaaatataaaaatccagcccagttcatgactcgtttggcagcaaccctgagacactttacagccctagaccctaaaaggtcaaaaggccgtcttattcttaaaatacattttattatccaatctgctcctgacattaaatgaaactccaaaaattaaattctggccctcaaaccccacaacaggatttaattaacctcgacttcaaggtgtacaataatagaaaaaagttgcaatttcttgcctccactatgagacaaaccccagccacatctccagcacacaagaacttccaaacgcctgaaccgcagtggccaggcattcctccagaacctcctcccccaggagcttgctgcaagtgccagaaatctgaccactgggccaaggaatgcccgcagcccaggattcctcctaagccgtgacccatctgtgtgggaccccactgaaaattggactgttcaactcacctggcagccacttctagagcccctggaactccggcccaaggctctctgactgactccttcccagatcgtcttggcttagcggctgaagactgacgctgcccaatcgcctcagaagccccctagaccatcacggacgccgagctttgggtaactctcacagtggagggtaagtctgtccccgtcttaatcaataccgaggctactcactccacattaccttattttaaacggcctgtttcccttgcctccataactgctgtgggtattgacggccaggcttctaaacctcttaaaactccccaactccggtgctaacttagacaatactcttttaagcactcctttttagttatccccacctgcccagttcccttattaggctgagacactttaactaaattatctgcttccctgactattcctggattacagctgcatctcattgctgcccttcttcccaatccaaagcctcctttgcgtcctcctcttgtattcccccaccttaacccacaagtataaaatacctctactccctccttggcgatcgatcatgcaccccttaccatctcattaaaacctaatcacctttaccccactcaatgccaatatcccatcccacagcatgctttgaaaggatgaaagcctgttatcactcgcctgctatagcatggccttctaaaacctataaactccctttacgatgtccccatttcacctgttctaaaaccagacaaggcttacaggttagttcaacatctgcgccttagcaaccaaattgttttgcctatccaccctgtggtgccaaacccatatactctcctatcctcaataactccctccacaatccattattctgttctagatctcaaacatgctttttttactattcctttgcacccttcatcccagcctctctctgctttcacttggactgaccctgacacccatcaggctcagcaaattacctgggctgtactgctgcaagtcttcacagacagcccccattacttcagtcaagcccaaatttcttccttatctgttacctatctcggcataattctcataaaaacacatgtgctctccctgctgattgtgtccgattaatctcccaaacctcaatcccttacaaaacaacaactcctttccttcctaggcatggttagtgtggtcagaattcttacacaagaggcaggactgcaccctgtagcctttctgtccaaacaacttgaccttactgttttagcctagccatcatgtctccgtgcagtggctgctgccgctctaatacttttagaggccctcaaaatcacaaactatgctcaattcactctccacatttctcataacttccaaaatctattttctttctcatacctgatgcatatgctttctgctccccggctccttcagctgtactcactctttgttaagtcccacaattaccgttgttcctggcccatacttcaatccggcctcccacattattcctgataccacacctgacctccatgactgtatatctctgatccacctgacattcaccccatttccccatatttccttctttcctgttcctcaccctgatcacgcttgatttattgatggcagttccaccaggcctaattgccacacaccagcaaaggcaggctatgccagagcacaagccactagcccacctcttagaacctctcattttctttccatcgtggaaatctatcctcaaggaaataacttctcagtgttccatctgctattctactactcctcagggattattcaggccctctcccttccctacacttcaagctcgaggatttgcccccacccaggactggcaaataagctttactcaacatgccctgagtcagataactaaaatacctcttagtctaggtagacactttcactggataggtacaggcctttcctacagggtctgagaaggccaccgcagtcatttcttcccttctgtcaggcataattcctcagtttagccttcccacctctatacagtctgatagcagaccagcctttattagtcaaatcagccaagcagtttttcaggctcttagtattcagtgaaacctttatatcccttacggtcctccgtcttcaagaaaagtagaacggactaaaggtcttttaaaaacacacctcaccaagctcagccaccaacttaaaaaggactggacaatacttaccactttcacttctcagaattcaggtctgtcctcggaatgctacaaggtacagcccatttgagctccttttaattaggccccagtctcattccagacatcagaccaacttggactgtgccccagaaaacttgtcatccctactatcttctgtctagtcatactcctattcaccattctcaactactcatacatgccctgctcttgtttacactgacagtttacactgtttctccaagccagcacagctgatatctcctggtgctatccccaaactgccactcttaactcttgaagtaaataaataatctttgttggcaggactatgctgaatctccttaggcactctctaatcagatgtcctgagttgtcccaattcttagaccttttatacctgtttttctccttctcttattccatttagtttttcaattcatacaaaattgtatccaggccatcaccaataattctaaatgacaaatgtttcttctaacaaccccacaatatcaccccttaccacaaaatcttccttcagcttaatctctcccactctaggttcccatgccgcccctaatcctgctagaagcagccctgagaaacattgcccattgtctctccataccacccccaaaaatttttcaccatcccaacactttaccactatttcattttatttttcttattaatataagaagacaggaatgtcaggcctctgagcccaagctaagccatcatatcccctgtgacctgcacgtacacatccagatggccggttcctgccttaactgatgacattccaccacaaaaagaagtgaaaatggcctgtttctgccttaactgatgacattgtcttgtgaaattccttctcctggctcatcctggctcaaaagctcccccactgagtaccttgtgacccccactcctgcccgccagagaacaacccccctttgactgtaattttcctatacctacccaaatcctataaaatggccccacccctatctccccttgctgactctcttttcggactcagcccgcctgcacccaggtgaaataaacagccatgttgctgacaaaaagcctgtttggtggtctcttcacacggacgcgagtgaaagtaagaattctttattaaaatacagtcatcacaggacatccatatgtctctgtctcagtctgcctgtctgtctgtctgtctaatctatttatcttatttgtctatctttctatgaatctaatctatctattctatcatctatcatctctctatcatctatcatctatccacgtgtttatcctatctatctctatctatctatctatctatctatctatctatctatctatctattatctctctctctctctctcctatatctgctttcagaggtattgtgggtatatttatagggactaaaatagaaaagacccatatagtatactgtgatgcaaatcaagttattctcagcatatagtgttcggtttgccctgccttcttttgggaattgtatctctcgtcttctgggaaccattctttccaccactgcagccataacagagctctcatggttttatccaaagttgtcatttcccggctacaaaaattagtccaaggatgtcactacttcaggctgagccagtcataacccttccccaggattttaaaaactgagcccagagagcacaagctcagtaccctttcatgggtgaagctgagactagagatattaggagctgtagatacctatgtttccagcatggcagagtccagactgagagaatgagcctggcacacaggactagcacagacttgaagagagagacagtcctggcagtgtctgagttcttgaagcccagcctgctcttgtgccttcccaatggtttgattttgtgaaccaaaaatttcttttcattgtttaagttacagttggtggtgtcgttgcatgtggtcaaagggtcctgactacttttgataggtatttgtaggttttactagcccatcatctttttcttctgtttctagtgacagcactttgattttctttttgtgaagcacctctcttcattctggtaaattggatcacacagactctcatatacccacttctggctgcaagcatggacgtataatccagacatggctaataagacttattctcaattttaattggagctaggggaaaagagaagctagaaatgtctgggattattaattattattaatcaaagaagcttaagaaatagatccatggctcagtgtaagctactttgcctcaagaatacatatgtgtcaagttttgatatacaaaactttacaactaaactctctgttcaacaaaaggtaagaagaaaggaaaagtgatttcttacctaatgagaaccttaaattcacagttaaacttcacagtttgcaaaggaacttggtgaggctgtcagtgtcagggctgttgccattagtatcccttgttgtcatctgcaaaaaacaacatgtagagaggccagtgattcatctaaggccagaaaccctggtcttggacccatgctctgtctgaccccagaggtccttccacaaccacactcagcattcctccaacaggctctgaggggctgccccagtgccctgggaagactgtgctctttttctgagatttgtcattatcttaatgaagagattctcataaatcatgattctttctgatgctaaaagtcctctgccaagcaaacacaagtgcttgcaacagtgaaatcttcaaagtgttggttcttacaaagaccacgaaaaagggttctctttcagcttaaacctccctatactatctattaaaatatagtgaggattacagaatcacatttcaacatataaagtcacctagaaaagtgttttcccaagactgttctcccaagatattccctgaacaaaatatatccattgttttattagttttctacggcagctgtgtaacaaattaccacaaactgggtaacttaaaacaacagaaatttattctttcacagctctgggggccagaagtctgaaatcaaggtattggcagtgttggctctttctgagggctctaagtgacaatctgtttcatgcctgtcctcttctatctaccagtgacagccagcaatctttgacattccttggctttgaggtacatcattccaatctctgcctccttcttcccatggctgtcctctctgtgtgtgtctctttcttcttataaggacaccagtcatattggattaagaacctgtcctactccatatgaccttatcttaacaaattacttctacagtgacaccatttccaagtaagattacattctgaggtactgggagttaggcttcaacacatattttttagggggaaacaattcaacccatacactggtcaaatatggttgagaaatattgcacactatacaatcctctttgcaaatgtgtattagcatattaaaggttttgaagccaatgaatctgtttgattttcttttaacctagcatttccaaaatgtgtgcaaccacacattattttattcacttaatatcaattaacatcctgagactcaatgttctgagaggcacaccatttgaaatgttcatcaggatgaccttcagcatatcagagacactcccccacttcctagttgttaatgagaacctctgtggctggcatgctcagtagttggtcagtaatgacaatatggttggaaacacagcaaaactctttccatgatgctataaaaccagcatctgtgcagcttcttataattgactcacttggcaatatggcaaattcatcccaaaaaagatgtgggtgagaacttgtacttaggtaaatgtaaagccttaaagccttatccattgctgggaaaagataactggaagaacatatcctgtggctattaggtaagaagcactatgaaactttttttctagttagaaaagtgtgtgtgtgtgtgtctgtgtgtgtgagtgtgtgtgtgtattcatcgagggctgtggtggaggcagagtgtgggactgaacagtggaggactatgcattcaaactagggaaacttattgtattaggattccccagaaaaactaaaccaataggagatgtgtgtgtgtgtgtgtgtgtgtgtgtgtgtgcgcgcgcgcgcacgcacgtgcacgtgcgcatgctcgtgtgtgatttagatctttaaactgattagatgaggcccacccacattagggatggcaatctacattcctcagtctactgatttcaatgctagtctcatccaaaaataacctcacagacacatctagatggaggactatctccatttactgaccacagcatgactgtgtgaagatctgtctcaagcactttcacacacattgtcttacgttgacctcatgtcaacccttagatgtaatttccattttacagatgaaagaactatggttaggagcatttataaaagtaaaattccgtcacaaatcgagcagtgaagtcaagttaaactcaggctggagatccactgtagcattctaccatctttccttgagaggcaagatagagcaacgtggtgaacctcaaatctgagactaccttctataaggcttattctgctaaaggaagcttattctgctgaggaattgttgccttgctttcctgatggtttcatcattcaggaagtagtggaatgaacaagggacagtgaacatttttaagaggtatttgttctactgcagttgatatgaatattgcctgccacccccggagttgtgcagtatacggcatgcagccctgggatcagctactttattttttttaatttttaatataacttatattttaggttcagaagtacacgtgcagacttgttatataggtaaacacgtgtcacaggggtttgagatacagattatttagtctcccaggtactaagcctaatacctaacagttatttttcctattcctctccctcttcccaccttccaccctctggcaggccccagtgtctgttggaacagctactttaaacatcattcttcaaatagtaaactaacaaataaggtaaagatgatgagaaccttggtagaatagaatcagattcttaggattcatagtagcatggtcaaaaatggtccctagaccataataataacttaatatttacccagtaatgggattgctggataatatggtagttctatttttaattttttgagaaaactccatactgttctccacagtggttgtactaatttacatgccatcaacagtgtataaggatttccatttctccacctccatgccagcatttgttacttttggtcgttttgataatagccattgtaattggggtgagataattggggtgagatggtatctcattgtggctttgatttgcatttctgtgatgattagcgatattgagcatgttttttcatatgattgttggctacttgtaagacttttgagaaattcctattcaggtcttttgtccattttaaaatcagattgttttttgctattgtttgaggtccttacatcatttgtatattaactctgtgtcagatgcatggcttgcaaatattttctcccactcagtagtttgtgtcttcactctgttgattgtttcctttgctgtgcagaagcttttaattttgatgtaatctcatttgttgattttttatttcgttgcctgtgcaagaaaaaatccttctccagaccatgaagcatttatgctatctttcaggtcatacattcaagtcttaatccattttgagttttttttttataaggtgaaagatactgttctagtttcattcttctgtgtatgaatactcagtcttcccagcacaacttattgaaaatactctttccccagtgtatgttcttggtgtctttgttggaaatcagttggctccgtgtgggtttatttctgtattctctattatgttccattggtctgtatgtctgtttttatgccactaccatgctgtttaggttatatagctttgttgtatattttgaagtcaggtagtgatgccttcaggtttgttctttttgcctaaggttactttagctattcggggtcttttgtggttccataagaattttaggattgtgttttctatttctgtgaagaatgccattggtattttgatagtgtttctatcaaatctgtagcttgctttgggtagtatggaaattttaacaatattaattcttctaatccatgaatgtagaatatatttccatttctttgtgtcttcttcaattttgttcatcaatgttttataattttaattgtagtgttctttcacctccttgattacatttcttcataggtgttttattatttttatacctatcgtaaacagaattgcttgtctgatttttttcccggatagtttgttattggcatatagaaacactactgaattgtgtgagctgattttgtattctgcaactttactgaatttgtttattagttctaacagttttttttttgtatgagtggagtctttagggttttctgtatataagatcatgtaatctgcaaagaggagcaatttgacttcctcctcaccaatttagattccctttctttctttaaactagttgctctggctaggactttcaatactatgttaaataaaaatggtgaaagtgggcatccttatcttcttccagatattagaggaaaagctttcaacttttcccatttcactatgatgttagctgtgagtttgttatatatggcctttattgtgttgaagtgtgcttcttttatgccccatttgttgagtttttaatcatgaagggatgttttctcaaatgatttttctgtgcttatagaaatgatcatatgggttttgtcttgtttacttttgtggttttgtggatttttatagtgctaagctttgattcctttctctttctcatttgtgactctgctgcatttttttcatgattgccctgaggcttacattaataaatattatagttatagatgactattttaatctaataacaacttaattttggtagcatataaatattctagacttttaccctcccagccacactggtaatttttttttgctttaatttacatatttttatattgtgtaatccttaacaactaattttaggtatggttattgtagaccattttgactttcaccttcatactagagatttaaagattatatctcatcattaaagtaatagagtattctgaatttgattatgcgtttacctctaccagtgagttttacacttttgtgtgatttcatggtagaaattaacatctttttgtttctaactgaagcactcccttaagcatttcttgtagggctagcatagaggtgatgaattctctcagctttggcgtgtctgggaaagacttttttcctccttcatttcaaaatgatagctttactgggtatagtattctaggatggaagtttctttttctccttcagcacttttaatgtattattccattcattctttcttggcctgcaaggtttctgctgagaaatctgctaataatccaatgggaattcccttatatgtgagttgacactttcttttgatgctttgaaaactctcgttgtgtttgattctgacagttgattataatatgccttagaggggacctatttgggttgaatataattgggatcctttgggcttcatagatctggatatccgtatttctctaaagacatgggacatttccagctattattttgttaaataaactttctgtgcctttctctatctgttttcttcatgaaaatcccatgatgtaaatttttgtttgcttaatggtttctcgtaagtcttgcaggattctttttgttatttttcattcttttttcttatttcaaaactgacttatttcaaaaaccctgttgtaagttaaaaaattctttcttctgcttgatctagtctgctgttgaagttaccaactgtatttttaattttttattgaagtcttcagtcccaagatttgttttttaaattgatatttatctctgttaaatgtctcattcagataataaattgtttttctgatttgttgaattgtctatctgtgtcctcttgtatcttgctgagtttccttaagttcattatttttaatttataaactacgatttctttggggtcagttactagagaattactgtgtttctttgataaaatcatgtctcattgatttttcatgtttcttgtatccctgcattgataatatctgtgtgtctggtggaacaatcacctcttccaattttatagggtagctatcatagaaaaaaatttttgcttgttgtcttgtcctagggtgttggttgggtaaggtgcattgtctttggttcctggtgtgtgtagtgtaacacctgtgcagtttcttcagcagtattaaatgtcagtgatgcctgtgagtgcctcagtggcctaggctggaggagtttgtgcagctgctctgctgagtcaagcctggctctcccactggggttaggggtgctggctgttctctgtgataagtgtgcaggggatgctctgcttggtcaggtgttgtctcccaactggggacaggagtgccaggctattcctcatgccaagggtacatgggagctgttttgctggattggacacaagtctccatactggggagaactgcttgttttctaggggacaggacattacatgagcttaggtgccagaattatgactgttcagctggacttaggctctgagtagctgggtttggggtactgcagccattaggatggggaagatggagtgcctcctaggtagtttattcccagtgtgtatgaagctgtaactactccactggggaatagtgttaccatgtatatctaccatgtggtggcaacagagcctcagagatggaaagatgcactacctactggcccctagagcaaaatctgctttggaagtggctctggtttcacaatggggcttgaatcatgtgagagaggagaaggggaacaacatgaacgtcttttttggagtaatgcatccacgtgaactccagacggcttactagactggtctcagggcctacgaggactacagggttttcgagcagtgaagattgtaggtgtctgcagctttaatggggacagttggaggtcccctgcttacccttttctcacagggagagtatctcctggtcccaagctgatcccaactgggaagacagagtggcaaaggcagagtgggctttttttcccccttttaatgtgggcatcctgaatctctgctccccagagtgtctgccactcgcctgctgtactctaaccctctccttcagatactctagtcaaaacgtggttgtttattaattgttttgggtccattttgtgtaaggggatgaatgttaggcacctttagtaggccacattgttgacatcactccagaatattctgtatcccttataagactaatgtgatataaagtttgattcatgagcactcaaaaatccacaaacattatgaattaataaatcaatcagaatttcatcataaaagtttccattgataagaataataattttttcttcagtaaatgaggtatggcatgggcttacctcacccggggtctgttccagaagtctaagaatttgaatactttgtttagtcttttatttcttcacattcattttgggaaaaattccctgaactataatttttaaaaagtgagaggtgggcttgtctttttagactatagtcctggtttagatttcctcgatttagatgattttaaaaaccttaactggaaaaatgtaaagctgttctctcctagttgagtgtctcttatcacataatggttatgtgacgttgagcaggttagctggctgagccttagttttgtgatccataaaatgagaatattacctttgtggatacgatgtttcaggcaattaaatgagatgatgtaagtaaagtgcttagcatagcatataaccaaagtgaaacctcatttattctcattgaagaaactctcctgatttgtcaggtgaagccatgttgtttcttccctttttaaaacatactagtgggtgcccagggcatgctgaatgctcatgattagaagttgctcaagatggtgtggtcaaggaccaacagcagttggcatcacctccacgatcatctggtgatagtaacccaaactcagacctgctaaataggagtctgcattttaacaatctccaggtgattcataatcactaaagtttaagtgattcataatcactattacaagtatacctgcataacaagtacttgttctcaagtcatttgatactagttactcttgcttttgtaattacataatttaactaaatatcacatgaagctaataagagtgtgaaaagagagttgtgtttttctgagaaaattaagttaaattctttggaacaacaatgatgagtgagttacaaaaattgttgttgaattaaggatgagtgagacaactttaaagattggaaaatgctaaaaatatatatgaatattactctttaagttcttctcttgcatgttttgcttctggactttaacttaaagaaatttaataacatttagtcattggctggtgccaccttgagaagagtgtacactcagcttaaaaaatgggtactgagtagccagtactttctgagaggggtaagaaaatgacactctccatgtctgtcaaaaccccagtctgtgttcttttaaatatgtaaacctggggatacaagcttggtataaataaacaagcctaggagaccaatgtctcactgactttgttggatgaaaaccgctgccagtgcaaagactttgaacatcctgggtgcaaaaatgatttataaattttaatgatggtgcttggaacttggcaaacaatcaattatgcacagcaatctctataaatatagtcatcaacagtcatccccagagctgtgaattagttcctattttcaaattattgtgaatttgctaactaatcaaaattctgaacacaaacgggcttattgcagatacatgatgcatactaagccaccagggaagtatctgagtgggcttagtaatatgtcttccaccacttgtattaaattttacaaactaaaaacagccaataaagagaaatgtttttctgaagcatctatgtatatctcaagctttggcacgtaaagacaagctgacttggcaaaagaagtgagatttagagtctgaaagcctgtgtttgaggctggcctctgtcatttagttcctgacttaatgtcattaggaaattggtaatgaccatattatctgctggaagcttgggaaggaaaagggaagttgatttgctgatttcttacaatgagtcagtgatgttattatatttacatatgactaatttaattctcaaaaatgctgagaaaattagacattatcttcatttaacagatggggaatatgatatgcagttactaatggcagaggtaaatttgaaccaaattctattcaataatagaagctgtgttcatttcattatacgaaactgcctacaaataagaagtttgtgaaactcatatacatgtaagttagtattataaatagaatgtcaaaatgtgtcccatttttaactgagactacaatggccaagaacaatatgttaggtgtctaatatccctacagaatgtcctaaagcaaggtgttagcccacattggaagtcccaaagtattgtaaatatgttttcccaatactgttgtatcatgcactttgaagcacttaaaggattgaagtaaagaggcctgaagcgaaaggatttctttggagagttgtaaatattcaacaatccccaacttccccttttctccaccaatggcataaggaaggcgatgtcttcctcttcatcataaaccagagtagaagtgctgaaaagaggctctttgagaggagagaagctgatatgctgaaagaagcgtgagaaaacagagatcagatgtctaccacagagcccgtaattgtgagacaggttgaagctgccctgccttaatggcaggtagagagggtttctgggcttgcattcagtggggcaaagatgaatgctctccagggatcaaatgtgaacttagtgaagggaagccagcctggaatgaagaggtgaccttaccagaggacctaccagaaactgtaggtcctatacatccagaatgaataaagacagatcacagatataactaccatgtaagactacttttttctctcctaatactgccatccctacgcctaactctggaggagtcagaaacatcagctagagtgtggggaagaaaaactgaccagccctatctcccctatctccactgtagttttctctgctggagtctaaagggggaaaaggttttaggttgaaagaatttcggagttacgtgctaattacactctcttaaacattttaattccagaaatgagattgttcttgtgaatgcaaaggtgccttccccagacattatcaggcagtgtggaagaaccagtttacaaaatgagtttaaaggaaatgatgagaatgaatgaaagtgcttgtgatttctccctcaagaggtgagatcattcacacaccagctttacaattatccaaagtgtggacttgccaatggtcctcattcacactcactaggttgtggttgatgttaaaggtcaggtggttgaggtttcttggtgtggaattagagatctggaagaaatctttatgatctttcaatatctagcacccagcacactgccccacatcttacaatatcaaatgttccatcaacacttgttgaattgaatgtagtccaaaaatcttcattttacagattcagaaagtgatgttcagaaaggtgaggtggcttgactaaggttggataactagtcagaaacataattgagactgtctttcaggccatgatccccttattacatctccattctagtgtaagctgcttcaaaaaacccagttatgagtctgagtaggctaggttatattgctgtaacaaattagcttacaaaatatggatttaacacaataaagttcttattttcttgcatgtcccacatggctgatgctggctaggtgagggctctgctgcagggaagccaggttgtcagaggctcttctgccatcttacgttgctgtgacttctatagttgctacagcagagagagcaatgaataaagcacactttttacactctctggaactagaagtgacacacatcattttctacactcaggccattggccagaataagcacatagtgccattacttgcaaggaagctgggaaatcttcccatgtgcccatgacagaaagaataactggatataacgaagctggtactgctatcacacgcagaaattaaaactcattttaacctttgttttcttgtttattgacccaaactcagaaatggtctctgtcaatcgtaaggtcacataggaggactgctgatggatggtcaagccaaaatatctctttaaaagcttttggtatgccatgtataaactcatacttgcttaagaaatttctgcaaaacagatattgcagccacatattagagcaatctggtaaagcagtctgtagtgctgacatggtaaaagaaagtcctgtgatgagatattttgttaacaggtgttatgtgttttttgaaatgaggattttccaataaaaaacaagccccatattcccaataactgaattatctcctagcaggaagatcacactgctttcataaataacatatcctcacaatgaatagtttcatataaaaaatgtcaaatactcaagttcagagaaagagtggagcttggtggcatatgttggtcacatggcttctcaaactagttctcaaaaatccatgtttttgtcaccatccctagatattctaattccagagacttggaatggggtctaagaatctgtatgtttcataagcacatcagcgattgtgctgcatgtggtcctcggcgtccactgagaaacactggtatataaagagcacaggttatggagtcagacttagaattttggctccaccactcacaaccagtgtgacttcatgtttctatatttgtacaaccacttataggttcttgtaaagattaaatgaaataatatatgtacaatgactggcacacagtaggcccttgaaaaatgctaattctcacacacaataaaaaatatatacctgtttagctcacctttgttgccatttgggagagtaattatgtcttatcccctcagtataggaaactcagcaccacctgaaaaactgcctaagtcttctttttccttttgtgactagttatattttcccacaaaaatgctaatgtgaaattaacttttatatttgctaaaactactagaaactagaaataaatccttaaaaagtcaagatatactttatgttcctccaaagtataggggcattttttagcctaccaggtttcaactattaatattaactttcatcagactttttcccctacaggaatattgaatgcaaggttcaatatgcctttgagaaccatgtttacatgttgaaaatactattcagaagtttatttgattttaaaactaatattcaactcattaaagttataaatttaaaagtccagtttttctttgtgcatttaacttcagtttaaaaatctcattattctattcttatgtctaccaaattttaacaactaattttagagggctttatataatgtttgatctcatttataaccttaaacaacctcaatattttaaactgcacatataaaataaatgtattcgatttctcttttatctgactcatctaagcaaatctattatggagcaatttagcttataaatgtagttattctaaatttccctaaacatttatacagtatatatcaactcagcaagacttccactaacaagttcaagtctaaatcagttagtacaaactttgaattgaaatcacaaggttaacctgtcacttaaaaatatttattttattgtagtaagaatgcttaacatgggtagatctctaccctcttaatatatttttaaagtacacaatacagtattattaactataggtactatgttgtacagcagacctatagaacttacttaccttctataactgaaactttatgcctgttgattggcaactcccatttccccttcccctcaacttctggtaaccactattctactctccgactccatgagtttgattattttagatacttcatataagtgcaatcatgagctacttgtccttctgtcactggcttatttcacttagcataaagttttcaaatttcatccctgttgctaaatgttgcaaaatttcttccttttttaaggctgaatattattcctctgtattattaataattaatgctacatttcttcatccagtcatccactaatggacatttaggttgtttccacaactttgggtattgtgaatagtgctgcaattaatataaaactgctaatagctctttgaaatccttattttcatattttaattttaaattttttattcattttaattgacaaatacaaattgtgtatatttatcatgtacaacatgatatttgaaatatgcatatattttagagtggctaaattgagctaattaatatagacatctcacatccttttttaaagtggtgagaacacttaaaatctactgtcttagcaattttcatgttttgaaatacatgtatttttatgccttgaaatacaatatattgttattaactatagtcaccatgttgtgccacagatctcttgaaattattcctcctgtctaactaaactttggtatcatttaaccaacatctccccaacagcctcccccaaccgttaccattctactctctttaagatcaacttttttggattccacatatcagtgagatcatgtggtatttgcctggcttatttcatttaacctaatgtcctccatgttcattcatgttgttgcaaatgacaggaatttccttttttaaaaaggctgaatagtattccattgtgtatatataccacattttcttcacctgttcatccttggctattgtgaataatgcttcactgaacatagatgtgcagatatctctttgacatactgactccatttcctttggtagtacccactaatgcttttgctgagtcatatggtagttctatttttaatttctttaagaacctccatactagtttccctaatagctgtactaatttacattccaatagtatgcaagggttcccttttcatcatccttgccaatgtttacctttcatctttttgataatagcccttctcacaggtgtaaattcatagctcattgtggttttatttgcatttctctgatgattcatgatgttaagcaattttatctgcttgccatttgtatgtcctcttttaagaaatttctattcgggtcatttgcccatttttaatcagattatttgttttcttgctatcaaattgtttgagttcctcatatattttggatattaatcccttgtcagatatatgatttgcaagtattttttttcccactccataagttgtctctcctgtgtgttgactttctttttctgtgcaaaagctttttagtttgatgcaaccccaactgttcaggttgcttttgtgttaatatccaaacagaaaaatcattgcccagatcaatgtcatagggtttttccctatgcttccttctagtagttttacagtttcagattgcacatttaaaactttaatctattttgagttgattattgtatacagtgtgagataggatcaaatttacaataactacaaaaaatattcaggaatgaatgtaaccaaggaggtgaaagacctgtacactgaaaacttaatagttttcaaaaataatttcatgaaaagtaatttcatgaaaaataatttcatttaaaaattaaagaagacacaaataaatggaaagataacccatgtctatgaattggaaaagataatattgttaaaatttacatatttcccaaggcaatctacagattcaaaccaatccttgtcaaaattctaatgacacattttcatagaaataaaaaaaaatcctaaaatacgtatgaaaccccccaaaaccccaaataaccaaagcgatcctaagcaaaaagaacaaagctagaaacatcacactatctaatttcaagatatactgaaaagttaaagtaatcaaaacagtattgtaccagcctaaaaacagacatatacactgatggaacagaccagagaacacagaaataaatccactcatttatggccaattaattttgacaaagatgccaagaacacacaatgcagaaagaacagtctctttaacaaatagtgatggaaaaacttgatatgcacacgcagaggattgaaattataccctaatttcacttcttttggataaatactgagaagtgtgtttactggatcatatggtagttctatttttaattttttgagaaaccttcatacggtcatagagactatactattttgcattcccaccaacagtatacaaggactgcaatttcttcatgtttttgcccatacttatcttttttttttttgataatagtcatcctaagagatgtgaggtgacatctaattatggttttgatttgcatttacctgatgattagtgatggacattttttcatatacctgtgttgcccatttgtatgccttctttggagaaatgtctattgaagtttttagcccatttttaaactggattagtttttttttttgttattgagttgtaggagttccttatatattttgggtatttatgccttctcagatatatagtttacaaatattttcttccatttcataagttgccttttgctctgttgattatttcctttgctgtgcagaaactttttagactgatgtaattacatttgtctgttttttcttttgttgctgtgctattggtgtcatatttataatccttgtcaataccaatgtcatgaagcttttctccaacattttcttctattagttttacagtatcagttcttacgtttaagtctttaatccattttgagttgatttttgtttatggtgtaagctaagggtccaatttcagtcttttgtaggtggatactcagtgttcccaacaccatttgttgaagaggctatcctttccacattgtgttttcttcacatccttgttgaaattcaattggtcatatatgcatggatttatttctgggctccctattctgtttcatttgtctatctacttgtctttatgccagtactattctggtttaattattttagttttgtaatacatttcaaaatcagaaggtgtgatgcctccagctttgttcttttttctcaaggttaatttggcttttcagagtcttttgtggttccacaggaatttcagaattgctttttctatttctgctagaaaattccattgagattttggtagcaattgcattgaatctgtctataactttgggtagtatagaaattttaacaatattaaatcttccaattcatgaacacagaatttctttccatttttgtgtgtattttaaaatatattttatcaatattttctcattcttagtgttaaaatatttcccctctttagttaaggttatttctaagattttctttttggtgttatgttattttaaaccaaattatattcctaatttccttgtcagtgagttttctatgtataagattatgtcctctgcaaactgggacaatttacatcttaatttagatttttttaaagattttttcttctttttattgtgggcatttagtgttataaacttctcttttattactgcttttgcagcatcacataagttttcgtatgcggtgttttcatttttgtctcaacatattttcaaattgctcttttgatatttttctttgacctagtgtttgacattactgttaaacaatcttatgttggaagcaagaaatgtttctaaataactcttactttttaaagaatattaagaattatagaatggtgcctcagtgtcaggttagttttaactaatatggttaattttgttagttttggttttgttggttttctctcttgctctttctctctctcattccttatttcactgatttctatttgaaacacttgtccctttgtgatatgtgtttgatgagttattttagaacattcgattctgctatagaacgtggaaagtgaaaaagaagtatgaataacaagtagttagtaaactgtgagatatattagacatagaatgagttgaatacagcagatgtgtgtttaacatagacttaaatcttctacccctggtgacacctattctacttcttgtgtcctttgcccaagaagtgcagataaaacccatagttgataataattagaaagctcaacagtagccacaagtacttgtccctgcaactccttgatagagtaagtaccatatgttggctctagtcacctttcataccctgtatcccattgctcagacctcaactctggtttctcacatccacatcttcagcagggaatacgtgattagagaggacatgtgaacactgtacccaaggattcacgtactgtggctataccatcatgctaatgccctatcctaagtgtgctaacctacctcatctccttcccaaagcttcccactaagtgttttcaattgcttaagtaaactgtgtgacttgagcatcttaatttagtctgtgagcctttctaggatagcttgcttgaaaatatacttggaggttatttttacatgaaggtaatgtctcatacgacattacccttctcgtgtttttgcttttactctgttgctcactttctgatttcttcttaaaggtatctaaagtttaagcttccttctaggaactgctctaggcatgttccataaatttagagatgtaatggtttctttattgaagtagtattaatacagttggccctccatagttgtggattccacacctgcagattgaaccaactatggatgaaaaatatgtttaaaagacagtacaattaacaatatgattgaaaaaatacaaatgaaaaatatattataataactatttatgtattatttatgctgtattaggtattataagtaatctagagataatttaaagtatatgaaaggatgtatgtagattgtatgcaaatacagctccattttatataaggaactttagcatccttggattttggtatgagggaggggttctagaaccaatctcctggtggacatccagggacaactgtaggtaaaactaatatgttgctggtataagatcggtaccattctctaattcttactatcctattaaaagcaaggattatttagatatgtttattgcctccaacatcggattgcttaggctgcaattttgctattaatttctatttttttgcattatgatcagagatctttggcatggtattcattcttttcttttttgttttttaattttatgtttattgtggcactattcacaacagcaaagacttggaaccaacccaaatgtccaacaatgatagactggtattaattctttagaattaatggagattgtctttaggatcttaaacatggctttttagtaaacattctctgcatatttaaaagaatgcatgtttcatgtttgttgagtatagtgtttggtatatttttaattgcttgagattgaatgttgtatttttcaggtattttaccatactgctaatattttatttgtttgatctagcatatgtgttaaagtcctcaattacaactgataaatcatctgtagggtctgaatgtttgtgttctctgaaaattcatatgttaaaacttaatccccaatgtgacagtattaagaggtggggcctttcggggagtgattaagtcatgagtgtgcctccctcatgaatggaatttgtgctcttttttttttaatttttttattatactttaaggtttagggtacatgtgcacattgtgcaggttagttacatatgtatacatgtgccatgctggtgcgctgcacccgaatttgtgctcttataaaagaggcctgagatcccagctactcaggaggctgcagcaggagaatcacttgaacccaggaggcggaggttgcaggagccaagatcacaccactgcactccagcctgggagacacagcaagacttcatctcaataaataaataaacaaataactaggcctgacgaagctcccttaccttcttccaccatgggaagacaaatagaatgtaccttctttgaggaacaggccctcaccagacaccaaatctgctggtgcctttgtcttggacatgccagcctctggaactgtgggcaatcaacttctgtctaaattacccagtctaaggtttgttgttacagcagcctgaatgtatcaatatgctactctttatgatatttttttgtcttaaattctatttagggccagcgcggtggctcactcctgtaattccagcactttgggaggccgaggagggtggatcacctgaggtcgggagttcgagaccagcctgaccaacatggagaaaccccatctgtactaaaaatacaaaaaaattagccaggtgtggtggtgcatgcatgtaatcccagctactcaggaggctgaggcaggagaatcgcttgaactgggaggtggaggttgccgtgagccaaaatcgcgccaatgcactccagcctgggcaataagagtgaaactccatctcaacaacaaaaaaattctatttagtcagatattaagagagaacttccaatttattttggttcatatttccccagcataacttttcccattcatttttaatcttttgttttccttttgtcttacatatatctcttattgcctgttgtgctttgtgtcttatgtgcatctcttgttgtctgtggggttttgcttttttttttcccattaagagaatctctgtttctaattggcgactatgatcaccttattataaatgttatatgaagacttatttcacacatcttaagacccatactcattaacttacccatattgctttttaattaccaaacctctgtctttctcctaaaaaagagaatctttatcctgctctcagatcatgatttcttcttgccctaatcttgtcaacattaacaaaattttagcttggggcatttatttggccattttggagttattgctagttgaggtcttttgtctttaaccatacagagtgttaaaacatatttctgtgaatatgtccccttctccattttcttttgtgtctttctgatactcctactgttgatattggtaattccatttctatatctcttggtttttcttttctgctttctatgtctttattctttcctgtttcctctgagatttccaatctagtttttaactcactaattaatttttaagtggtgtctaaattatcacgtgttacttatttcaactattctgtatagtgttacttcaggtattgcatttttataaccagtagtcccactggcttccttttttctgttgtttctttttaaattaattactaattattgacatgcatgtgtcctctctgcttctatagtttgtccaaggttggtaaccagagagggaactagcaccctaaccagtttgctatcttggctgtccctcatgttcctcagtgtctcttctttcttgtctctctgccttttttcatcatctggtgcatagttgaatgggtgaatgatattcataatcttcattatcctacctattcagaccccagttctcgaaactgataagtggaaatcctgctagcaacagtattaagtgcagccctgactacttatatgtagcttttttgcaggcctgaaattaggactggtgtgtccattgagaaaccatggaaagtttcccaaaacatgttttgtctcttaaatatctgcacaaagacgacattcaaagtatagaagctgcaaactagtgttgtgtttgaaaaactctctggctaaaaataaaaatcaccactatggaaagaaactcttgaaactacagaaaaataaatttcatctgaagatcccttttggttgaaggaatctatggacattcaattaagttaattttggaccaaaaagatacatgttgtgaattatctctcttctcttaacctatgagaacttactatgtaatattttttagagctaaaaaacgggaacagccttacccgtgagaggctggctggtacagtaggaccaccaagatggcaatttaaaaagcagagcctttgggtatccttgattcaaatcctagctcagctacttactaactgtgtgatcgtggtagacaatttattcaatttctcttccatgtaattttctcatcactcaaatgggcataaagagaggattcataatgttataaagagtaggtgagctaatgtctattggtctattatattgagtacggtgttttaatgattaatgtttatctctttctctttcttcttaaattatctctctattaaagggatgctctcaacatctttaagctcacaatattcctctcctgaggagagcatatagaagttgcaatgcatgagtgcagtgaagaagggactacatcctgagaaatgcttgctgcacagagactagccaccgattctgctgtgcagagatttcaggagtttacagctggttctatgtttagttgtatggcctctgtatgagagaccagtgtgctagctttaatcagccagtctggcaggtttggatggagacagatttctcaatcttttctgatttttttttcattaaagacatctcaactggttgtattgaatttctattaggcacttcacctgcaagactctgagattttattggaggcaaaattctccaaattaaaataacaggtctcttaagcaaaagagactgtagtgacatgaggtgacattgctggtcaataggtgaagagggatggcatagcttgtgtctcattggaaggatttctgggaaaactagatagaaggcattgaatttctgtaaatggaaaatgggcattgattagtgacttaagagactggctgaccaatgcttcagataatagaaaatctctgaaaattgtcagagatgcttgctaatctgaatggaggaagatatgatattagaaaatcttcctgttcttttttggttacagtttcaatgactgtgttttctttccttcaatgcttcatattattcagagatattaaaaaatgttaatttcacgtccagaagaaaaaaaatcagaaatagttagttcttaatttgcaaatgttgcttctctatcttcctttgccctcacatgcacatattatcatccttttctgcatgtttccagttattgtttcctgtaacctcctgcttgatacgagttattagttcagtaaatcaactttcataagcttaagttaggaatgtcatcttgtttactctgtcaaaatagcaaatagaatttcctgcttttacttgattgctcttctaaatatggattctgatctaccctcttcataaataatttcattttaaacccaaaagtgttaactcctgtgataactagttaagctgtaatctaaccaatgaaagaaccaccattgtagaccttgttgtcaagaaagtgaatcctgcttgagactttgtcctgagatcttgttctgagaatgtttcttacaactagagctcttatgtccagtgttaatgaggagggaagatcacactcagctaccacctccagccacatgtgtcactttgctcttccacccccaagatatcagtggttatggttttagggtaatggttcacttagcaggttttgatttttacccctgcaccaaaaagaagcagtccctactgtaaagaacgtttgccttgataactaccattaataaatatttgttatatagcaggatggaaggcatatgaaacatctgttgaatcgatgtttaatgaacgaagtaatgaatgagaatgattgtagctcaaggatgatagcatttttgtcatgttttttccaacattttcccctgcagtaactgtaatattcatttgcacctaaaggcctgttttggatcaaaaaataggagtcaaagcaaaagggaagctgaccgtctgagtacaaacttatctcttgaggaatcatgttttatggtatgatgcgaaatattgtttttgttcctcaagatcacaatgataatatctatcggtattccccgtggaatgtaagggaaagatgtaatccttacatatccttttggaagaagtttcccagatctcatgaggccacaattttggatgttctcacgtaatgagaagaatctacaaattgcgcctcttcccctttttagtccatcagagttctcatttaatcctcattttttccatttcatgctttccagatctgaaaatccttccaatggtgggctttatgcattctaatgatagttaattggttgcctttcgtctagccttagtctctcttccaaactatattaaaagccaatgattgattgtaacaattctaaggatctgatgtgatattggacagatcaagtctggtcccagaataatgaataaaaaaacaagaacaataaaaggatataatactttcttacacttgatttctttgctgtgcttcctaaacctatgcaatattgattgacactggtgtgtggttttgtgttatcaagggcatgagaacagtgtcactgaatttacaatcaaattgagactaaagatgtttgtactaataaagataataaccttgatatttttgtgtatggtttctaacctatgcttttagattatctttcccactcctacagtacaaatgagatgggatggtagcagcccatggctgaaatcaaaaacagcatggaatgagcaggagacgagatgaatgaatgaaaagatgaataatatatttctttagaaaaatatgcaaatatacatctttttgcttttaacgtactctgtattaatttatacatatacacaagcataagcatttcacataatttgggcagaactatgtgcaattctataataagctattttgttttcttcaacccctactatattagcataataacatctaaaatattttagcaatatattatcacatttgtaccacagctgccagaaatactctgttttccatgtttgtaaacaaaaatagaacaatactacataacactgtgattggaaaaataccttcttttcgatcccccccttacattcagtaaaggagacttaaactactttagtatcccaaattcattttctctgtagaaatataattaattttctctgggtgcgctaaatatgtaaccataacaaatcaatttattatctttccacaactaaatcacttctgaaaggcagtggcaaaatatgacatagatgagactggagatttggagggtttcaatgtacctcctcatttagcatacaaattaaataatggtaactctgattactgttgcaaattcacaaattaatttcaggtgccagtaacgatactggtttattcaggattttcaaaaatcttatactgggaagtaaagagagatatgataatataatactggattttaatgagaaacgttaaacatgaattgatttatggttaaatttggagcagttaattttttcccctcctgttttggtaataacaagaaacaagcggtcaaccacaagttgatttctaattagccctcctggatcttcctggaaaagcctgagctctttttaagctttgaagctgggtggaaagcagttaatggacttatgtggagtcttttaattaccaatattcaacaaatttatcttttactgctagatagcacccaagggcaagaggtaatctgctttataaaccttggagtaatttgctttataaatcctggagtttaggggagtggcaaactctctttaaagggagtattgtcttccactaagaattatatttttggcagttttgtaaaaatttttagtgatagattctttgtgacctctcagtttataaacatcagcaaccaaaatacattcaacattaagaccaattctttacaacagctaggtcctgcccaatggacaggcttgtccaaaaccaagctgagcatgtaatgttttcagcaaattgactctaaatttcttttgcattcaaagcatacatcttcctgccaaatgcaggtctttttcttcacatatttactaatctctctattagaaagccgctttgtcttgcagaggtcacgtagttcatgtggtttacattgtaaggatggtaaaacatctcagtaacatcagaattgactgaaatttaaaaaaattaaaaatcagatccatagccaaatacagaaataatctaattcaaaatccagagttaaaaataaaaatattgacagtgattttaatatttcaaaggtataaatggctcagtattgacaaggagcaccctgtatctgaactaggtcaatttcattgtttttctttgatactttgcttgcattactgtgacatttgcatctcagtcctggatgaatgatggagttcacaagttgcagtgggagactccattcctagactgtctcccaaagcaacagtaccaagaataactttcttcagatttacaatggacaaattcactgaataattcttcacaaatgatatgttcggttcctgggaggatggagaatactttaaatgcatggtctttctcccaggaaatgatggctcagtgatcacgatgctgtgtttgcttcacattcaagcagatgactcttgctctatgatattcaaagggatgatctcagcactctcctcgccttggttgttggctggttcattcctcagctcctgatggcagatgtaaattgggatgtcgccagcctccgcagcagcggctgcagcgcgagcagagcggttggaggggcgcctcccccaacgctggttccactgaattttgaattgggcccattggcgcttcacggtggtttggacctggaagagaaaaaggagccttgtttttatatgatagtcagaaatgatccatgcaaagtgtacgaacatcgttcttagagcttatcagatttaaagaaagttaaattgtaattctgatctaaagggctgggctgtgtatgctgtggccacagaatatatcaacttggaagaagaatttgcaaatggaagaactgagttacttgcttaaattacccctggcaaggttgtttgctagttttaagaaaaggtttctttagctttcatatccaatgaataaaagttgatttggtttcacaggtaatgtggtatacatgtcataatagggagaaaggttgaccaaactttttatatgctaccatccctgataaggcagaagtttttaatttaagtgtgcacatgaaaaatatatatgtaaaccatagcacagttctggattttatgataatggcctcgtacagtgaacttttccttgtccgacatgacttgagatgggttatgccagatacatctctggttaatgccatgacaactttttaagaataagattttctctttcttttgaaagacttctaaaatgtaaacaaacttgccagacttgttttataaatacgataaattatatattgaaaacaagaggcaaagatgctaacatcagaaagctctaaatatgaaaactacaataaccacaactgaaaacagtaccacagacagtgaatttgcttgtctagctctgctttttatagaaacgaattcaatttagtagttaagttcctccttcctgttgtctccaaacttcttgcttttctctatagctgaacaaaactaaaaaagagattattgcaataatctctattctgtatttctgagtttctattgctcagtacatacaacaagcttacataaaaatatttgcatcaatttatgatacatccttagttcattctgctgccaaactcacatatgacagctaaacacatgagagagaacctggggaatatataatgtgaactaaatcatgtaactacttgatcatggggaatcattttatctactttacatttgtacaaatctgagagatgagaaaaatgacagcaaaactgattaatgttataaaactatatgtataatataaggctgaatggttctgtggcaaatatactttttttttcctgtatctagtagagtaataatctcctctgagaataattagtattgttcatatatttttaaagattttactcagagaaagacaaagtcaaatgattcctcaaaaagcaactaaagggggtagtttatcttcacacagcacagcaaccgtaaggttcgaggtgacaaatggcaatcagaattatttagcaatctgataatttggaatattagacttttcagattatggaggcaacacatcctgagttttgttttattttgttttggggttaatgagtgcttgcatgaagggtactttatatctaaagtgatttaaaacggacaaagacaaaaactttaagtgctaaggaataaggtggaccatgcagctgaaagttgtattgaaaaaagccacgcaagaacaaaagatagaataacaagtttcagctgtttattgagtgtttactaagtaccgtatcataagtatgtgatttgtattaacttatttaatcctcacaacagccctatgggaagggcactactatcttcactttatggatggggcactgaggttatgcaatgtgtccaaaatcatatagctagaatgtggcaaagccacagtaccaagcagagcctggctttatttgggtggtactattaccgtagctttaaatgccagggttataatctaggaaccatcaaatgccccattgagaaactgggaaatatacaggttcagcacatttttggagaagcaatgtctccagtcaaaggaagctgataggccggtcgtggtggctcatgcctgtaatcccagcactttgggaggccgaggcgggcagatcatgagatcaggagatcgagaccatcctggctaacacggtgaaaccctgtctctactaaaaatactaagaattagccggcgcctgtag

SEQ ID NO: 38 - DNA, 66525 bp, Human
ttccaattatgtggtcgattttagaataagttccatgtggtactgagaagaatgtatattctgttgatttgggttggagagttctgtagatgtctattaggtccacttgatacagagctgagttcaagccctgaatatccttgctaattttctgtctcattgatctctctaatattggtagtagaatgttaaagtctcccactattattgtgtgggagtctgagtatctttgtaagtctctaagaacttattttatgaatctgggtgctcctgtatagggtgcatatatatttagagtagttagctcttgttgaactgttccctttaccatcatgcaaggccttctttgtctttttttttatcttgttggtttaaagtctgttttgtcagagactaggattgcaacccatgctttttttttttttttttttctttccatttgcttggtaaattttcctccatccctttgttttgaacctatgtgtgtctttgcacatgaaatggatctcctgaatatagcacatcaatgggtcctgactttttattcaatttgccagtctgtgtcttttaattggggcatttagcccatttacatttaaggttagcattcttatgtgtgaatttgatccatcatcatgatgctatctggttattttgcacaacagttgatgcagtttctacatagtgccattggttttatattttggtgtgtttttgcagtggctggtactggtttttcctttccatatttagtgcttctttcaggagctcttgcaaggcagaccaaatggtaacaaaatctctcagcatttgcttgcccagaaatgattttatttcttcttcgcttatgaagcttagtttggctgaatattaaattctgggttgaaaattcttttctttaagaatgttgaatattggcctccaatctcttctagcttgtagagtttctgttgagaggtcttctgttagtctgaagggctttgctttgtaggttactttgcctttctctctggctgcccttaatattttttcattcatttcaaccttggagaatctgatgattatgtgtcttggggttgatcttctcatgaaatatcttagtggtgttctctgtatttcctgaatttgcatgttggccagtcttgctatgttggggaagttctcctggataaaggataggtaaattctatgggtaatacagtagatatagtgcaacaggaacttaccagttaagatacagtcataaccactcacccctagttggaatgtaggtttcacacaactcccactgatgaaaagaaatatatgtatttttcaactgtttaaccctttgttaagttttcttgtgtaaaattatctgcagagccatgaaaaaccatttgatatttgtgactaagcagcctgtttggatgattatgctcttcagtatgaatggtgagctgttaaatgacatgctcaatcattgctatggaagaaatttgttcttactagcaacttgaagcttaaagaaacatttataggaaagaaaattactcaaagctttaaataaggctacttttagagttggccttagactacctagagggcatgatgattaatctttcacaaattacagattttatttgttcatgtccagtgaggtgacttcttggtggacatcttcattgcaattttcagcagctctatcaatgacacatgttaactgaagctgacatgggttgctcttgctctcttggaatgtctttatttctgtcctaatatgcaaaggtagtgccagaatttcttaataggagggcctcaggtataacaatctagttgacaggaaaagcaatggaatcttcactgcatttgcatcacaagcatactgttttttcttacgtgtgttttttagggtgtcttgggatgttgatcctctttaagtcaaatagaaaaaatgaaaatgaaatgccatagccaatattagagatatattaattttagtctttgttgcttttatatttttctaggacaaagagatcttcaaaaatcaaaaatgaggttcacatttacaagccggtgcttggcactgtttcttcttctaaatgtaagtaaaacaaaagtattcaaagccatgctaatgaagaatgctgaataaggaggaatgttttgagtgtgatttaattagtatttgcaagggtaggcattggtctccagaagccgaaactaagttcctcaaagccattattttgcttaatattttgttaacaaatctctcctctgaactgtctctaatttaaattagtgtttgtggtctacccagaaatttgagttttgtttacaaaactttagcattaattttagacatctccatattatcttagaaattaacatagttggtaaataatattctcaggtaaaatgttttcatgttgaaaaaactatgttttgaatcttagttcaaaactatgatttgaatgatagtttctgggctgttcaatccttttaaaacatctgggctgttcaattcttttaaaacttctgaactctttcagtctggctattgatttcaaatgtatttttcatcaaaaactgactatggaaacttcaagtctttatataccactattattctataactctttctccaatcttttaaattatgttcagtttgtgtaattctatattgttttattcctaaaagatttagcaagtaatcggaaatataatcatcttagagaacactatcaatgcctattatttgtgtcaacattgttaacctaccatcacatcagcttcaatagcacatgaatgggagatgagtaaattttacgtaaatcaatgtggagctgccttgcttcttatcctttctgtcacatcagagtaacatttgctaataaattacagttggcagcaaagatcactcaatatctcatactgtcatactgacccacacaaagcttgcatagggttcgaggatttccattgtttattaatgtgtagttataggcctacaagtctgtctaaactgtttgtctttatattattcaagaaaaaaatattgctagtatttcataaatgttaatttaatttgtaaggcaatttttattttgtaatattgtacatcaaataaatggtgtatgggaatgactattaatgcaacccttttgcacctatttggataatgagtataacttattttattgtcagtttgtcttatcattttatcctattaaatatttctttagataaattacagtaaaattttctaaaagtaattagtatttggaaatgcaggtttctttatgtcactggaaatataataaaaacactaaacaagactactatggaaactaatagaatattttaatttgccagtaaatacccaggccttatgtggtcttctatggatgtaaaaatattgctatatattattgatattgttatttttcatagctcaaatgaaatcctaagtgatctggtatatgtgaatatttttgaataatcatgcttcataaataattatattgaacatgacagaagaaaaactaaagaaagaactaaatactaacaaaattgtttgaagattatctaattaccttttttattacaaaggctttagaaaatttgtagtgtgttcaaaaagcaacgtaggtcatttttattcaaaacttttactaatgtagtctataatttaaatattgaaaaaaatgcacatctttgcatgagccatggacagaaacattttatggcttgtgggcacctcttgaccagcaagcataactgaacagggcacttaaatgggtttgtgctctctttgctgtgacagagagaaatttgcttctctctctgtatttggattatatatttgatttggaggatttgtccataaaacaaaatttgatatgtccattttcttcaaaacgtttattatgttcacactgacacttctcagagaaaaaaaattttaatgacaatgttcctaattaatccgaaatattactttttagacaatagattgttgtgaaaatacactaactattgaactctatcaactcgatttccatataggttttaaagtctcagtttgggtcaccaccttcaattagcctctttccattaaccataaccacccactcaattcctctccctcctgcgaggtatacagtaagcttagagcagcagttggtatacagtgagctctcagaaaaagatgccagtgacgatgctgatgacaacaaagccaatggtaataacaaagacataaaaattaggttcttcagagcaggtgttattgttacttgtttacttatctatgttcacctatttgctttgaatttatgatatatgcagtttcgttgtttatataatgtaagtagaattacacagtacaccagccaggcatctgatcttacctgggaaaaccagggctaacactttttacaacagtgtgctttgtcctttcttattttgaaatgtgtaagtaactgaaaagcaaaaataattatatacattatcaacattaaggatggtgacatgaaaatctcattggttgcatcagtttgtggattctaggtttacatactttttagagtagttttgcatgtggcaatcaataggaagctctcccttcagcacagcagcttgggtccatacactcagtgggcttgaactattgcagagatggaccatttctcaaagttccatgaagaacagctctgtaactgtctctgtacttctagaaactgcctgtaacccaaaagcaaactgactgtcctacatcacagtaggaattgcataagcatatgaccatttcaaatcagattcctttcctgtggattccatgattagtgtggataaaatcaagaatgtaagctctatgagagcaggtggcttgccagtttggttcactgctgaatttccagaacctagaagagtgcctgacatgtgagaggcactcaaagtatttgtcgactgaaaaaaactgatgatgtttgggctgctgactactgctgttggtggcagcttggtggtcgtatgtgtgacgccatttacttgaacctttaggagtgacatcacatatacggcagctaaactgctacatgggacaacaattaagagttttgtttgtttgtatgttgaaaaatcatgtaagatggtttatatgcaaagctttgaaaactgatgtttattcagaaaaacaatatgcccttaatatctcatttctatctgaatgtgaacatataatcatatttttatttaaccccctgaaataagtagtatagacataacacttataataagtaggatatttgaagtctcttacattgtttggtagtttcatccaatcactactggttttattttgtctctgtattgctgaaaatgataccaccttcccagcaattcttatttgtataaaattatcagcaaaagtttaacatttaataaactttatgaaatttgtatatgtgttatttttaagcagtagtaattccatgattgtaattatatatatataatatacataaaatcatacatatacatatatttatatgtttatatctatctatctgtctgtctatctatctatctatctatctatctatctatctatctatctatctatacagtcagccctctgtatccatgggttgtacatccatagattgaaccaatcttggatagaaaatattcaggaaaaaattgtattgtaaacatacagactatttttctttttattatttcctaaataatacagtataacaactatttacatcatatttacattgtactaggtataaataatctggggatgatttaaataatacaggaggatgtacataggttatatgcaaatactacaccattttatatgaaggacctaagcatcctcagattttggtatccacatatgcaaatactacaccattttatatgaagtacctaagcatcctcagattttggtatccacaggaggtcctgcaaccaatcccctgagtataccaagggatgactgtatgtataaacgtaatgccccaatgggtatgttattttaggaagaaggccactgagacattcatctactgttgggaaaattccatcttcagtgctcaaatatgaaccagaccaggaactgatgcagattattactgctcatctgacaacagaggttctaatttttcattccttcagtgttgaaacaatctctactgaaccagcttcaaacaagttcactggagtttgtttcaatattgcaagaatgataagatggaagctactttcatcagcatgaattataactactcgtatacagattgtcgtatttccactgttactgatgttaaaactgcattaaagcaaataaaaatataattgaaaatacaagcatagggttttctacttgttatcctcggacatactatttgcctatggtttccatgaatttccaactagagcaagaaaatctcttggttggttgtcagccatataaaaagagaattcagaatgttacttttgggaagaaagccagatttaaacaaaatacttcccagtgtttagcatatctaatacaagtgacagataagatttatatatgacatcatgttccatcttctaattcgatttgaagatggtgagaaaatggtccagaaattaataatacatcaaatgatcattctcatattaactgaagattttagagccacaaaagaagaatctaaaataaatgtataagttgaaccaataattaatatctctattgtgaaggcatcatgatccattcttgttttgatggttgcctaatatgtaattgaatttttaaaacacacatattcatacaaaagttgagtaataaactaaaaaaagaaacctcaacatggaatcccttcaaattactcttttttaaaaattttgcaaatcgtgttccaattccattaggaatatctaagaattttatgactgatgattctttattgttcataatttcaagtatcagaaatatattttatagtgttggtccatcttgccagactgtaagctctatgagagcacagtctacacttattttattcagcactgtatcctcagcatctggcacaatgttgggctcatcaagtttgatcaatatttgctgactgatctgaagaccagtggggaaagtgtcatatatcaaaagaattgtgttcagctacactggtaaaggatttgcacagttataatcatttttatgggttcattactttctcttctgacataaattcaagagacattaaaattagaaatcaacaaaatgtttaaagagtagtgtcaaccttattcacaattggtgtccatttgaagttatcacagtaatgttataataatgataagtattcaccctcttctctttgcaagatatttccactaggatggcttgctaccatctccaaatctaacccaaaataggacttacttaccaagggggagaagttccccctaataaggttttcctttcccagcatcttccctttcttgggaactatttttttccccaaatatctaggctaattatctgggctatttgactattactgtttcccattccttgtattcaaatatgccttcatgtttttattattgagaaggtgctaagagtggtactttcttgttccaacatggactgatctagtccagccaggccttcaacttcctggctgcccccaccccaccccgcaactttaacctgtggacatctgatgcctgctgcatgaattttactaaaaattctcctttcacaaccttcactgatcaaaaatctacaaaacatctttatcatatatattatgttatataccatgttttaacaatattagctaaaatgttttgaacctttcatgtccctgacacttggtgtttattgtcttgttcatcctcacaacatgacagatgataaatattattcttaccgctcttcttattttacgtttcctaggttgaggaaacagatctagtgagaggttgctaacctgctcaaagtgacaaaacaagttttaactctttttttgttatctgaagattcagataatgcagtcttgaaagcaaagtcctgaccttcttaccctcaaatatgctccccttcaggcaagatggttttctcacagtggctcatgcatgtcatttccaacctccagacttttgtgggaaaggtccctccatcccaaaaggcttctcgacccccccttgtgcctatgcagaaacttcccacactcaagatacaattcaaattctaccttgtatctgtagccatcctgaatatttttgctccctactctctccaaactctgaattttgattggattctgtgctggacagcttagcagttagtgatgtgctgtcgtgtaggacatatacaatgacacacatggaaaacagtgaggattcaccatgaagagccaggaatatacatgtcaacttaatagggatgagttttgtttagaaactagcacatatagaagagtacataacaccacttctgccatcaatacaattggagaaacttcaatcttagaattgaaatttcaacgggtatgatagaaattaagcagcattcctaaatttagaaaaaggaaagtcagtgcaggctgatgtttttaggtctcctcaaaaaaagaaaaaaaaatctctatgcagaacatggatattaaaaattcgcagattccaacaccactaaaaacattggtcatagccacaaaagaaattgaaatctttataaacacaagttaggaagaacagtgtgacagagtgatcttttcaaacacccacattacctttgaaaaagagaggcttgtgatggtgatgattaactgaaactgaaaaaaactattgtcaatctgtaccaaaatgcaaatgtgctgagataaatatctaagaaatacattgatttttcattagtgaacatgaattgccctgtacaggtcatctgctgttgaaaccaatttaaggagattatggtcaattatgaggagcagaaaacatattttgtttgttccatggaatagatgggataaatttctggcagtgtacacagcaccaataaaatttagctgaaagaatcaaataaaaaagcatatttattgaactatgtctattttttaataacatgattcatgattcttaagagtaaggcaaagttgatttcatatttgtattttttggaaattagattatttgttttgtttacttctaaactttagaatcataatacagttaaaacaatcctagctgataaagaggtatatgagtgtgtaggtgttatccattttcaatagtaaatggaaactaatgcaaatgtaaaatgtgccagtagaatttgtagatgaaatgtgaaaacattttttgtaatatatatgaaaaaaactgtacatagagaccatgaataagtattgcttagagagcaaaaataaatgttttcaaactttttcattgtctcatttatttgtgctcacccattcctcctgtctataagtaactgatttttctttttaatacagcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtaaagagaaggatatatatgaacatatgtttgaaacaccattacagacattttcttttgtggttaaatatgtgttgaataattttaatttaatatgccagcagttttcacagcagttttcacactatggtatgtttgtgtatttcatgcagtgcatatgcctaatttctttgcccaagttcatctgactgcaatttggctaacatctgccctcatgataaaattaccgcaataattcagtattcacacctggtgagccggaacagtaaaggaccgagtgagggaggggatgtacaaaatgacaggaaagggaattggaaaatagagggcagagaatttgcctgaggtggaccctatcaaaccctatcttgcttggattaattaggtagtatcttccctttaactgtcaattggttggcaacccatactattcttccacactttctggccccactttccaggagaattacaaaaaggtacctcctagccagacattgtttatctaccagcttctctagaatggctgtatgtgactgcccagatattttcaggtctaaacatattctattagctgtagaggacccatagaaaaacaaaaggggagatgtgatgggcaagctcattgcaacatccctttaaattctcctacttgtcccctgaggcatttgaaaagattcaataagatcttttactatatatatatatatatttaagacagggtctcactctctcgcccaggaggatcctcccactttagcctcctgagcagttgggactacaggtgcatgccaccatgcccagcaaatttttgtatttttttgtagagatggggttttgccatgttgtccatgctggtctccaactcctgggctcaggagaggttcccaaagtgctaggattacaggcgtgagacactgcatctggcctactaccatgtacattttaagacaacccaacttggtagggaaaaaaatggtaaaatatactctgttactgcacattctttgctttcaaatagttcaagttttagtttgtagttcttatttttaccattttcctttaaacaaaaacatcaagtcaactgaaaggcagatacatattattcttctgtctgcagtaatttcagtgtttatcaagaactgaacaggcattagacataactctgaccaaaggagaaacaatttcgttgaagccagtgagacaataaaaacacagaactgatatttttggggttttctgagagctcttttcattttttaaataatttttgagagctttcttgaaagcctggatctgattcttttgaatacatacctttatagaagtaaatcttcatggttttaggtagaatttttttttttttttttttttttttttttttttttgagagagggtcttgcagtctttggggcatttgcttttttgatgcactcaactttggaaccttttacaaagtagaaatagaaccctgcttgtcatccaatgagataatttggtcacagatatgctaagcctatttgaaactttatttccaaaataaatgacttggcttgtttgaaatgtggttggttatgactggtgtagtgagctcagctacttgtaatatcgtcttgggatcaatcttctcatttagttaaatccacaaggcttcaatatcaatttccttctaaatggccaggtccatattgcaatcgcacctgggatggatggctgtgctgggatgacacaccggctggagtattgtcctatcagttctgcccagattattttccggattttgatccatcaggtagagtgtttattttcattttatgttcttgctatgaagcttttagagttttcatggttttgagaagaaaatcagatacaaaatgtacccacctaatcatactccacattttagcaacttctgaagtgtttccttaattgaaatacttcttagttgtacaaatattacaagctgtccttttttttaagtcatgttgctggtcagttatatgtgttggtattaaattctggtttataaaaatagcttttctaaaactctgtgaatagttttatttaaatgtgagttttaaaaatttttcaattgtctcactgaaaaaggggtagaaatcttaattatgaaggagacccagatgctgaaactaaatggattagctatgggcacaacatataggtccctgttaatgggtgaaatttgttcccaagagtaaagtgagcctgagcctacaggggttaagtggctctagaatcccaattaaagaagaaaaatgagtctacccctgaaacaatgttagaaaaatgctttttgtgcttccttccagagtgaaagatctaatctgtccctgaaaacaaaatttcacctcagtaaggcagagataatggaagtggaattgcagaggacctcttttaaaaccaatgcaggccagccacttctgggaattcccattgtgatggaaaagttgggatgtgaagaaagaaagggctttgtgctgtgccctaaatcagctacattcctggaatctctaactaaatgctatttgatgataatccttcaggcccttattgactcttcccaatgaatgatgcttcattaatcttgatttgacaactacattagaagttacttgattggcacgaagagctgttgtgcaattgaggctactaggccagttccaaagtaacaatggggctcttgccaaagtggatataaatagtgactacaaggcaaggttttgataaaaaaatcagagatttacaggcatcgatccatcttttcagcctggttcttatacagaaacctctcagctgcaggataaattcattttaaaagtgtatctgaaatatatacatatattccaaacttaaattataaacatatacataacataatatatatatacacatacacacacataccaaacttaaattcttcaggattttcttattgacctaaagcttacatcttaatgatgtacaaaacacattaatgaaatgccagaggtttgtttcactttggaaaaagtacttggtaaaagatagtgaaagagtgaagaactgtattgaaattcaaaagaggctgacattctgaaggaatatgctggaatgtaaaaagcaaaatttaacaaggaagcatttacagccctgcacttgaagacaaacaaacaattttaatggcacagagccattaaatggtccaaatatggtttgggacggtgattctcaacccagatgccctttcacaaaatgaaaaaaaaaattgtgagcttatgaaaaatgcagatgcctgacccctgtccagatcaatagaatttgaatctctagggacaggacctcggaatctgcaagtagttcccctgcgtgaatctggagtgagagaagcacattgtacttttcatgggtcagtccacacatagagtattttagagagaaatatcaattatcaaagcacatgtggagagtctccaggctgttagcggaaaatctgtggggagtgaataatgggggtgtttggtttctaaagggaagtcccagagtaaacataatcctttcttcaagtattgaaagactcatcaggtgaagtaggacaaattcttgatagttataacagttaaaaccaagaaatgactcgatccagactttagttaaaacaaaacaaaaaataccatttgctatggccttgttcatgagtggaatgaccttctttaagagtagtatctctctgcatacaatatattttcccatacctggctgcataacttcattgaaaccaaattacattcattttatttaaaaaaaaaaaactactttctgcaatctaataaatataaattgtggccacttttaaaaattgcaagtaagcttggaagggttgtcattgacaaataacattagcaaaataatcgacaaattttcaacatcaattttttgtgctgattagtgctaatcctttttcacatgttgttaatgtccaatagagatgctttaaatagggtttgtctagtggctatctcagtaaatttacagttttaagttttcttatttaactttgtaacagatttacatgaagcagtaatgattctaataggttgcttgaaaacatcttttgcttgaaaaaatgttttttcatccattttaaataaaaattaaacatacaaataactctataacctgcagtttaaatcttgcatttagttcaataagacctgtttcggtcatacaataaaaaatgatgaattatacctaaaaattgccaagttgaaaggacttttttactagctcttagcagattgagtaaccaaaactagtaatagaaaattattttaaatattatcagatctcagtgatttttcagccaaataagtttctcttttctttagtatgttatttccttagccttttaaacaatagcagtgttcttcaaatattaccatatgattctgatttccacatcctgtgctaaaaaagaacatagccatctataaaagcattatctatacgtacaacaatgctttgcctttgttaacatagaaaaatgcttcaaaaatattttccctgagaaatgatcaaagattaaaattttgtgaagattccaaatacacttgcaaaatctccctgcatattataccaatctaggcttgctatttgatctctcagacaataaacacatcgaatgggtgctttgaagaactggagagtatctgaataactcagattaaatttggcaagtacattcattttagtgtttacttgttcattatttctatgttatttaattcaacctgattttttctttcagttgcttggccaattcagaggttagaatttaaatattatcttgtagctaacaacattatctaaaattctttaggtcactggaatggaatgtagataaccttgatcatttatgagatttcaccttctagagtcccagtaccaaattaaaatattgttgaccagtattataatacaaaagcgaggttttttttagacaatccagccaaattctaattttatttcagtgccattttagttgtttgctaacaattatactagttttacagtgtgtttatcctgctgataatagtgtcttgataaatattatctcaccattctgaccactttttactcccaatatatattgatgtgatttcccagcctcatgcactttacccagaatctcagatatatactcagttaataattaagcaaaatacagaacaaagaagttttcttatttatttttaagatggagcacttgatgtagggtctggtatattttaagttatcaaatgttattttaaaaaattattgtagttgctatggtggcctaatattttagtgtgaatttcagcaaagatatgagtcatccccatgagaacttattatttctatcaagtttggaactttactttgtactgatacatatacactgcctaaaaaaattaaaataaaaaaagcagcaaggctttatcatactgtaaccagcactgaatatatcacacaaaaataattgaaaaaataataagcctgatgggaaccagcagacaccacaaagcaagcacttggaaaaagttctttctcagggctcaaagaaaatcttcttatccttttcctccaaaatattttagtgtaagctgaactcttaagctcagtgggcagccccagaatcactgacctgctggttggagggatagtaagatgtcaggctttcctcctctttgctaagcatcaatttcaaaaaaaaaaaaaaaaaggggggggggccaaaccagtgttaccttttatttctatgccaaatccaacttccaggtaccatttacatcatcttattttctcacctacatctgcatcttaacaataagggcttgcctgttttgtttcctctgaccagttggcacattgccacagaaataagaggcttaattagtgcttaatagctctgcaatagatttggaatcaagtagactcggatttgattcctgacctttctacctgctagttatggaagggaaatttacttatatataaaatgggaagaacaatattcacttcaaagactcattattaacgttaaagaagataattctgcaaagtgctgagcacagtgcctggcacccccatagcgaaggtggagatctttaatatgccaatccagctgagttagggatttcattaactagcatctatgagatactttaaaaagtcaacattaaaggctgaagcctggatccctatatattttctgtgggatgaagagagatgattcaaatgaaatctcttgagaggcagaaaaatggcctcttgatatatcccttagttttggacttctttgttctattggatttaaccatatgggattgggaagatttgaacatttgatccaaaaattactgtttcatacagttaatctaatgaaaaaacattgcaagtaaataaagaaaggtatgttcttgttcttctctagtagtttccatctataatcaaaagtttaatgtctgttaaaaaattatgaggtagagtataggtagcactttggagtctgaccgatatccatgtctttgggtctaaatcctggttcaatctcaagctccatgactcctctcactgtctgctttgaatttgtaaaatgaagatggcaatgcctacttcacatggctttgctaaggataaaatgagacaatacatattaatacactttgtataatacatgatttgtgatagtctctactgacatactcacattcaagttctataaagtgattaatatgttggaatggcttttaagctttaatttattatttttccttgttgggattttgagatattaatgcaataactgttatgtttcattaacagaaaaggttacaaaatactgtgatgaaaaaggtgtttggtttaaacatcctgaaaacaatcgaacctggtccaactatactatgtgcaatgctttcactcctgagaaactgaaggtaggttctttttcacgtttcagtattgagtgagaatgtcattatttgtacaaggaaatggacgcataactgtaaaatatctgccacaaagaagccaacaggttttgtggaaagaaatcatatgataactggtaagttctaggaatctctagagtagaattagagaaaatgacatttcacttcttggttggcactcagagtcaagagtcaattgaagttccgtgagcatacagaatcagtccatttatggcagggggataagtgtccatagagcagatgaaaggattcccaatgatgccagaaattaggcaacatttcaagggactctctaacatctcttttcctggaagagtttcaaaactacagatttttccacaagtcacaagatagcatgcttcccctgtgttagccacaaccttagttttgtaataaagcatagaaagaactcctaaagtagggcatctcatcagtccactaatacagatatggctgcttagattattttcagtggaagttcattctcaattgttagtacttgcattttactgtatgttaaatattttgaatattatctctgcttagaaacatttatctaagcaaatggcgggtggggaacagatgatctttcttcctcaaatgtatcaaaaatctgaaaaattcaccaagtctacaaccagcctcctcaccctacagaacaaggagttacagttggtcaatgtttagctgtgcagggcgtctctaagcaaccctgctgactctaacataaacctattatttctgtcaaagataggcctgtatactaaataattattcagttgaaaactaaaagcacattagtgtctttgtttgctgttgagatgctttcagggtgtagaaaagttttcttttattaaaaacaaaacaaataacaaaaacaaacgagatgaacatatggcttagggaccacttgaataggagggacacctcatcacaagcacaagctaagggcaccacagccagttatctctttacaaatggtttagtcaccctgagaatcagatgcatgtctacaccctaatggagagctgttaataaagtctgattaataagctatgtcacagagtagtgaattttccgaatgagtgttgattatgatgttacagagaaaaattatactcatgttaaccagattgttgtaagtagtgcaagtccaaatcattcttagtgttgtttttggacttctcacgtacactggccacatctaagaatgaaataatttaaagaagaaatgctactctctaggcacttagtataatgattaaaatgcttttcacattctcagtaaactatcgcaagaacaaaaaaccaaacaccgcatattctcactcataggtgggaattgaacaatgagaacacatggacacaggaaggggaacatcacactctggggactgttgtggggtggggggaggggtgagggatagcattgggagatatacctaatgctagatgacaagttagtgggtgcagcgcaccagcatgtcacatgtgtacatatgtaactaacctgcacattgtgcacatgtaccctaaaacttaaagtataataattaacaataaaataaaataaaatattgaaaaaataaaaataaaaataaaaaaataaaatgctttccacaaatcttccatataaatatagtcacattaaaatttgaaggaaccaacctagaattcattaaaaaaaaagtcaaccttgagaatgacacaaggatggcaactaaattatgagttgttgatttaatcttacacatttagacaactctatttcagaagaacaaatgtttttaaaaggagtactctggaagcaactgaaaagaatatgaattaagttatataaatttttcttagaaataaagtatgcaaagattttttaaaagaccgacagaagagggggtgcagatacatatccaaattaattaaggggcaagagtgttctacatagtaaactatttagaaggaagaacttttagaaaatgctcctcctgatattgtctacaagtgaagttagaaaaatagccagaaaatgaattcctgggagaaaagataggtgagtgtgtgtgtgtgtgtgtgtgtgtgtataagattcctaaatccctcccaagaaagctacctgaagattttatcagctccaattataaaccaactattctaactttattaacatttcctgtaagagtaaaatgtgctattaagagagtggtatcaacaatgaaaatgccccaaaaatatggaatgcctggtcaaatgatgcaacaggcacaacttaggagaagctaattagtccattttgaaattctaaggcctagaaaaggaatgttcatttcaggataacataatgcacataaccaagaaagggctctgaatagtttggatgcattttagctgactagggcttcaatcccagactctttctgaggaaattgacaagaatcaaaatgttcaaggatatataaattctacatttattccaggaattcaaagaacttcatagaaggtattcatcctatctacactacatttgcattcataccaagacccaacaaactgttgaaggaacttaagaccaaaagccaagagattaaagtacaactacaaaataatacacaaattatgcttcaccaagaaaaacaagtgaaaacaaaatccctagttgcaaaagattcaagtctacttcaattacagctgatgaaattggctaaatagtacaaaatgcaaaagctagtgtcaaaatagagtgaaagagagagaaagagagagagagagaccagaaacacagaaacagataaagagaaacagagagacagagaagacagagagagggatgggtgactggatcaatctctattttctctgttgataaaattacattataaggaaaggaaagactgtgattactaggaaaaaagatgctatgacattatgcattttatgagaaggacattcttccgagtcaacataacattatgggagaataaataaaattaaccatgatcgtgaaaaaaaaaaagaattatcaaatggctgccaaggggaaaggtttcggcttcaaccaactaaatactaatgatatcattttaaacaaaggcacagaaacctgccaccatactctctggaccctctgtaggtcaggacagcttggaaagtcgattactgctttgccagttctgtggtatagaattatgtatccactgtctaaaagattccagaagttaaaaaactaccaggattgcttactgggcttagggatgataatttttaatgcatttaaagctacttctgaaatatatttttgaatgaggtacttcatctcaaggaactttattctttgaaaatgacaatttattttcataaaatgacatgagtaaagctaaaaattaatttcactatctgaaatatttgttataattgtagtaggtttttaaaaggaggaaaacatttgttgatttacatatatttagaaatagaaatgattttctctctgatgaatcattcattcattgtttgtttgtttactttttgttgttccagaatgcatatgttctgtactatttggctattgtgggtcattctttgtcaattttcaccctagtgatttccctggggattttcgtgtttttcaggtaagtacactcacagcatctgctctttatttcctcctttaagttactgaaacgaatggtgaattctgcaagagtggaggtggggaagggtcttcagcaaattacaagcgacatgcaacattaggagtcatgaagtagcaagaaaaatgaaatgaatttaaatatgcttttaatcctatctttggggagaacaggataaatttatatcattttcaaaagtactatatcttgagacttcccaaaataagacagtcctgtgaatccataagtatactgttgtaatatggtaaaggttccatttaccatgggtaagttaccattaagggtggtggagaggattctccaccttcttttactcccactctaatttttggagaccatagccacaaatccatatataccctgcctaattatttcttgctagcatatgtaagactaaggaataaacaagcacatcagagcatgtttctacaaaacctaatttaaataatgcttgtctttaggttttatggtgcacaattatgcttgaaagcaaaatatgagaaaacatacaaggaaaacttgaatactttaaattatcttgtcatcttacatgaatataaaataggatctttacaggaatggtacatttaagttagaaactgttacatatgctttcatcacaaccaactttagtgaaaataaagcactcataacattgtcctaagctggatttctcaagtatgttcacaaatgtagattcagagtaaactgtatgtgtattttttttttagacacaccacggttcagtaaaaatgttagaaactgaagtaaattaggtaaaaatgaaataatacatgtaaggtgcctggattcatgtctgacacataataagtgaaatatgtgtttgatatcattattattattattattggtagtaataatagtcatggtggtatcacagaaatgataaagaaaagcccttttgtagactcagatgaccaacaatcatccacacttaaaaaatgtggtatgtgattaaatgtacagtgattcacatatagaatgaggggggagaagaatatatatgcatttatcactactgaactatatgtttaaaatggtaaagatggtacattatacatctatactttaccgcaaaaaataaatttaaaacatagtagaatcttaatttgatttttgttaaaatattgtcaggatagtactaaggaaaattaaaccaaggggagaataatcacctgtaaatacatccttagtacaagtactatttttttccttcatcatttttcaatctttgtctatatcttagtcaagattcttatattgactaagcaatagaggtgaacagcaatttttaactggatagcaaatgataacataagcaaacagacaatgagctccttccataaatggtttaacaggagaaagactgataaagcaaaaagacatgaagtattaattactcaaattagaatagaagagtattttcaatgataatgatcagaatacagtaatcacataacatgattaatcttggaatgtcttcatttttcaattgcacttcattatggtaaataaacacatcatcatggttctcaaacaacttttattttaaaatatgccactaaagcatattttttaagttttttaaatataatcataaaaaaattgaaagaaaaattccccaaatttgtaatcatgcaactaattgtagtcaggactttaaaggtaataatgtcaaaggcatagatcttaattctttatttctccagtcacttaaataagtgaggagatgtgagagccaaatcagcaaagaaattaagaatttttttttcaacgatcatttctatattaagctactgaagatgggtgtgttaaagtgtggcacaagggcaaagtagaatatttctcaactccagttagtcccaaagcaaaatgattctgatcaaacccttgagagagtgtgggggcagattgtctagaaagtacccaactttgccctaccgtctctcagttctaagaaccaactaaacagcaacttaaatctggggaagaaaaacaagtcttattgatttatcatctgagcctaataatgagaagaaatgaactgaaatagctggttcttcagagcagacacaacaagagacaaatgagatatgaaaagcacatatgctgagatgccaaatattcaaaccaaaaaaagctgtataaaatttttatacttgttttcaatcatatcttaaaccttacccaaactaaaaatataaagggcatctgtcttcttaaaatttaagtatgatcctaaccctttaatgttttttatatttgaatttcagaaacattaaaagtgattgtggaagtagaaaataatactgatctatcattggaatttatttgtgaattagcaaattttttccagaattttttttcaaatactctacatcaccatcacctttaagatctttactgcacattacaataggtttcataatttatgcacttaaatgggatcatctgtgtgcaacctgagcaaaaaatatcatcactcccttacttaattctatattcgcagggttgagtaattttgcaaactccaaacaattttataaaactttcaggaaaccagagtgaaaagttacccagctccacttctgagagctgacgccccattcacaatcattccattgaaatctcactgtaaagccctcagaactcctcaaatgtgtctcataaaaaggaggaaccctgcagctgtcctcctcaaatgagcaggcctcctaggaggcctgcagagaaatttaaagtcactgatcatacaagaggctttggaactgccaatacttcactaaaaacttgggatattactcagaattagtttattaaagcatgcctttaatcttaatgtaattttattctgagcatgcaggggaaggtaaaaggtggaattatgtaaacttaagcaaatagaaatcatgctccttgtgctgttggaaaattaatgtataaatgtacataaagtcttcagtttaatagcagaaaatttatcttctatgcattcttcctagagaaagacaaaatgtagaaaaaacaagatttttcaggtttaattcatggaaaagtcagcattaacaatcttaactgttcaaaagtttgaataatagtcaagatgatatgcaggtcatttctggtacaccagttaaagatagaagacagcattattaggatggtatttagtttaaaaccttcgcagaaaaaattggaatgatattatggaaagggattaaatataaacatcaaattagttcagcaagatttcttactgctagattccaatagtaagtgtcaacaagagagctaaaatgaagatacccttagggaagactggtttgggaaagacacataaatggacatttatttcagtttgattcttgaccattttcagcaaatttccaataaatttacttatccataaatttcaattacaatttatcaatttacttttctgtggaataatcctaaatatgtaagcctctcattgtatcacttcatgaaaagcataacagaccattcattagcatttattttgactcattgttatccatgtctttctgattggtattttaaatattattcttgcctgaaagctgatagaaatataggttggaaaacagatggtctcttcattttattgtctacattacgttacattggccacattgacaaaaagcatatataggtaatcatggaggtcaacaaaagtggcttccagtggaacatactgagggaagactgattgctctactacttactattctctttgttctacgtcatctctacatattgggtgggtatgtgaatctgtaccttgtgtagtatccaccattatacatctctagctgccttcctgttgctccaaggaaaccatgaaatcaatggtatcaaagatggcctcctttcttccaactcaccactggcaggacagacaccaaagataactgttgatcataccacggcatattcttcacccatagaacagtagtaataggaaaagcaagaattttgattgaaagagaatttattaatgataaggattttgtgctaaatcaaaaggcataaagtctcttgtcaaatagggaagatatataatatattgtatttgaattttcccaggagttttaatgcaatccattttacttcattttctctctttttttcagttctcatgtttatcatgaataacacgtgatcctaggtaaatgaaaactaaaagttacactagaagatatgacttgggcttgtaccaattacagaaatgattcctaattcatattttcccatgcaccagtaacttcaaaacaacttttacttgttttctttttgctactttgtttgctttgaatgtgactataattacactgtcttacataggagatatacaggagaaaatactgctgtttctcaccctgtgatagcaaactgatttagtcaactggcaaaactcaagaccaatatcaaatgccgtctcatacaactacaagctcccaaaaagtacacactcacacacacgtagggtactaataacttgaaacaaatgtgaaagatttacaccagatgaactataaccatgaaaatgactttttgctttagccttaaaatgtgacatcttgagattcatactcaagtaaatcattatctctttctcacatttgaatgacaccttgattggtagattatgttgtagaagtaaattatgttgtctcatcctcctactactggagaatttatggtacttatggtttcccatcactcaaataataagcaatgttctgtccatctaaatgtctgtttttttcataaagggaatagaatatagccagtgtcaagttagtgctatttctacctaagacatctcagatctgacaaaaaaatgttgtcggcttctctcatgttcatttaagcgacgtatttgtactgaggatttttaatgttaatttcaattaattctctctagcatcccacacctcttcttcagaacaattatcacagtaaaattaaattaaaaatggcatagtatataagggccctgaaggcaagagcgcctgtttgtcctctgttatattcctgatatctaccaggtctggatcataatgagtgcacaatcatatattttggattattgaatgaattttgaaaaatttgcaataccttcgactcacttcaaaaagatgactgtaaatgtcatcaagttagtataatacaaattttaaaactcaatgagcaaaaattatattaaaactttcaaaaaacagaaactcatatattagtcatacttctcctttggaggctagcagtttatctagttttaaactatcattttctctgtgtttccaatgaaaaatatatatatttttatatagagagatacagtactctttatatgtactgtatctatctaaatatatatatactgtttatatgcatatatgctgtatgatatattcatttttaactagtgttgaacaacaggataatgttccatgttagctagttaatacgaaactgaagaatttggcaaatgttcagtatgatatgaagtataaagtaggaaatcatctagcatttaatgtaattctttggtgtactggaaaattgcttagtggtcacagctcaaaacagaacatttttcttaaatacatttttaaatttaaaaaaaaatgggtattaagcccaatgatgtgtcagagagtgttctagatgtataaaataaattcctttagcactttcattttagtgggaggaaaggagagaataacaggcaataaataaatatatactgtgtcagcaggtgataagtgttaagaagaaaagtagagcaggcacacaaaagagtaagctggaggtagaggaagtatattttattcagggtggcttgggtttacacaagagaatgaagttaatgaagtcatttaagctaatgtacaacagcagattattgaacactccccaatcaaaagaaaaccaggcttaagaatatcattgctgtatgatacattcattcatactccttagttctagataatgtcaattatcattggtctaagccaggctgaattaaacaatgaatcccataattaactgctagtgagaattataaattgctgttgtgactatgaaggatggcaggtcacagattcaactgtgctgattgcagcagtcaccagatggaagtttattcagtataaacgagcatgaggtttcacataagtaatttttttgtttaaatttaaatttgcaacctacctttagtgctattataaaaccagttgggtttgatttatttaacagacttctgtactgctgaatagagtagtccacagaagcgtgtgtgtaagagaaagctcttctctaaatcctgtctttatcagagcctgcctcatggatgtaaattctacatcctatacctgtttaacaagttaaatttttaaaaatattatttattaatgagttactataatcgcttcccgaaaagttgaaaactgtaactataatagttaaaatatgctctaacagctgcctttattacttaaattgctttttattgcagaaaattgacaactatttttcctttgaattggaaatataggaaggcattgtaagtaaacccaggctatttttgtatttcatctttccccagaatttccttttcaaaattcttcatttctaactttattccatgaagatatttttaggaatagttagtgttatgagtcattggcatgttttacgctctcacatggtgaatgacattatactaatattttttgccttatcaaatatgataaatataagattttcatttgtctagaataatcaccgcaattttgttatagccatgatgtaggctctctctattgcatcaaaaaatgaaataggatattcaaattaatgtttatttatgtgaacattcacaccaacacatatgtacaactttatgaactggagagaaaagaataaaagccccaataaattgcttaatacacaaaaggtggggaatgactctaccaagaagcagcagcacttggatagctctcattggatccaaatcacagtatgcctcataatgagatttcatttgagcctattaagaattctctgcctgtgtctgagctccaccatcaggagggttggaaaagaggaactacagtgatgattctagttgaaatataagatctaagaagatggtaacagaaatgatggaagaggaggatgccaggagacgtgaagtgtgtgtatgcaatggctcaaggacatagattcagtaccttgtcacaggcagccttggttctgacttcacgctctgtgacctcactggccacatattttcttcctggttgcaacaatgaacagtaggcttttcatttgaagcacactgcagaccctaatagttgctaatctaagagtccttctgttaactaattttacaacatttgttataattaaaagagattttatcacccactctttcagttattttatgaagtcaccctgaggactgaaaactatgacctgctatgtttggaaacatgttttttaaaatcaggcagaaaagtaggaataaatctgaaagaggagaccagccttactttcttctatatgttctttcatcttttttttaaagaaaatatgaaaaatattaccaaaatgtttttttccaggtactccaacattttggcactggttaatgctttatgttactttttcttccaggagccttggctgccaaagggtaaccctgcacaagaacatgtttcttacttacattctgaattctatgattatcatcatccacctggttgaagtagtacccaatggagagctcgtgcgaagggacccggtaagtactgcatagttttgtttttacttttattttaaaggatatagtacctgtaaatagtgaacatggtgttcatgttggacttaagcagctgtttacatgtgtaatcatatttacttctaccgtcgagttttgcattttgtgaggcatatcatttctatgtagtttctgtaagaaattatagcagataagaatcatacaacaaaccatatatatatatatatatacatatatatatatatatatatttttttttttttttttttagatagagtctcactctgttgcccaggctggagtgcagtggtgggatctcagctcactgcaacctccgcctcccgggttcaagcaattctcctgcctcagcctcctgagtagctgggattacaggcatgcgacaccatgcccggctaatttttttgtatttttagtagaaacggggtttcaccatattggccaggctgatcttgaactcctgacttcgtgatctgcctgcctcggcctcccaaaatgctgggattacaggtgtgagccaccacacccggcccaaaccatgcatttctaagactaaccagtaatttattaacatttatgacaaatgtattgagcacctcttgtgaacatagatgatactaggtacactaaggcagtgcttccccgtgattctagtgtgccacaaatggttacaggtgtgcctagatattgatcccctcttcattctgttgccaagttgggcttggcccagtcatctctcctatgagtagctattcccttttgctaatgaaccatataaatatgatcatgttttgtgtcattatgctttggaaaaggtttataatgacacaggaaatgcaaaagttagggcaacaggacatacatctctgaaactcatgcccacatgcacaattgcaacaagcaaatatggtgactgtcctccttctatttgagtactatagagaacaggagagctgaaatcatttagctccattactgagaaccattctggatttttcctaccagaattgtcctgagagttgttcagaataacccatatttgtcatcagtcttctctctttatactcaagatactgtttttcacagtgatttccaatcctggctgcacttcagaatcaacaggggagatttcataaatatgaaatagctactgtccacatggtactagagagtcagtaggtatgaggtggagccgaggaatataccctggatatttcttctgtgctgccaagtttggaaatcatcagccaactactggatgaagcaaataaactggcaggggaggacagaggaggagcaccttgaggctctgctttttcattgatatcagtccctggtattacaaactaacaaaaaccagaactaaaaaggattttggaggttatttatccctgactcctcattttacagatcagaaacttgaggataaaaaggcaaagcaatttgcctcaaatcatataactgattggagcggggagcaggcactcaaattcaggtctccttactctcagtttttgttctttcctttgcattgtcacatgtgtctctgtaaatcagtgagggcttagtaacaccaaactggttgattagttttccacatctaccagattaattttttaaaaatcaaatcactttggtgctgtgataccaagtaaccatttactttacagaaatttttatttatcaatccagtgtttaaataatttataattgcagcctctattatttaatagttattttgccctcagtaaatattttcatcccaaaaagtccccaagtacttctctgctttctcctttgcaaacctgctttccttaattttaacaacaaatcttttccttatttgttaatggactgcactttaattgaatgattcaaaatagtttaatgatataactgtttattagattgagtatgaaattaggaatatttgataatttttgttctgcaaaattggtgaatccatatgttttatcctaatgcaaatgtggagacaatacgctggaatctagtaacagtagggactattatcaccccaggcctgaatggacaagtggagggaaaggtatatgaacccgaagacagagaggtggtgtggtaaaggaggccctgcggaaactgaagacttctgtcttaggacacggccagcctatggcaaccccacaaaaggaagtggagaaataaatatcccttgttcactcactctcatattccagtctctactgatggtccccatagctgagctcaaccagaaaccagagggcaaggcagccctgctggagatgtacagatttatttctgtgggcccagggcagtgggagcaggatggaaagtgcatctggaagcacaaatagaagctatctagctcacagtgaagggccaagggatattttcatttttgtttctctgcttaactgtgttatgcaaacatctgtagatagcctcatctttcaaaactggcttttgacaattctgccaacccaataactaaaatgcgtgaaatctgcccagagcatgcatcctgtgtgacagtggcgtggcgtgggaaagcagcttaatttggcttctaatggctccagagtgttaataatttttgtggtatgaatatatgcagagagacattataatctatcttttaaaaccatggcatctgttatcagagacaaagtccagtcttacctgcagaataatgggaccaagtgtgtttatcttgatgaattttcctttttaatgtcaattgatttaaagaaaatttatctctaatttaatctttgcaatatccgagcaatggatggaattatccccatttttaaagctggggaaaccgaggctcggtgagagtaagtgtcctccgtagcatgagtacttagagatgggattcaaatccagacctatctcacacagcagccaacctctcttctttaccacttggtgctgttgattgtctttatttattgtcctagaaagatgtgttcttaaagaaatgggctcagccattccgaagtgatcgccgcctataaccagacatgcccactacagttaattagggaagctgaaccccactgaggtgaaaacagaggtagaagcaattaactaagaatctctctgcagaaaacagtcacattttggctctccatttcccattaagagtagaaaccgtaggaaagttactctctgtacggagcaggccaagaaatgaggcttccgtttttgaataatcaactacattgatctgggagcatgctcagtcacattacgaagtatcataattcttgaatagactctttctcttctttttttgggagtctcacacccatatctccctgtctcccatctgtaaatgtaaaagggacttcttatccactgtgagatcttgttcaacctatcttcctgaaatagtcaaaattcaggtttttttctgagtttgctactaaattatagaaaccatgtagctttatgcatctaatgagaataacaaaaactgctctgctcacttcccagcggttgtcctggagcccaaagaagcataaagcttttcaaaactcccaagggcctaatattacaagtgattgctcacaaggttgctgtcaactctcaccttatgactaactccctaggtctctgtacttgacttttccaacaaatctgttactctattaattgctcttggcagtctcattattgtcattgctagatgtttccactttcgtaggctttttaggggtagacatgcccagggactctgccagacacagcacataggctgtcccccagccaccactaagtcaaaacacatatgccctgcagctcctgtatcacctagtaacctttaataaaccccataagcaggtgtctagggacctggctctgccactaggcacctgatttcctaggagaatatgagtgtgagatttagggagccagagaaattaacaggaaactttcttctgtgtatagaggagtgagattgattcacccaaacacactaggcattcttaaagtatgtttgaaagaaaggaaagaagcttatctttatgacatgactagcacctggttcttccaatgtatttttaacctaacagacttgctggttttagctatatgagagcaaacttcctaaggaaaaacaataaaacattttaaagatagaattttatcccatcaatcaagtacttattgaccaccaaaaatgtaacttttagccctcaggctgaaatgaatttatactattttggaaacatatctgtgacatccccttcatgatccctcacaatgagccaagtctcacatggaaatagctttgtgagtcttgcaaccacacatatggggtttggtcacatttttacctctttcaaactgtttttttttttctacagaaaacaaagaggcaaaaaacttggatatttttctctatatgcctaaaagggcccatttccctctgaagttagacaaaatgaaaacaagccaccaataacaagccacttacaatgatcaatggggcaatatcatatgtgagaacacactgtgcctcttgcatattttcaaatgtctgtttcttccataagagaaaatttggaaacacatgtccctcctcaaatacatataaacagcatagactaaaacaaaataactacaatgacaaaacttaattcatgtctgtagattgtgaagcatacacttcacccagaggaaataaactaggctatttgtttttaagcactttctctattttaacacagtcgttttccaatgagagttttgttagatctcttatctaatcctccatatacaagcaacatagggttgctctctctaggcatgggaaaatcagtttaagaaagggaaggaaataattctcaagaagacatgttttatacattattcatccttgaaactgcttatgtgccaccaccaacaggaacacacatggtgaaatttgtattgtatttcaccttgaaaatccatattctgtcatagaagtccaatttcttgagtatcttttctcatccaaaagattattaaagtagattacagttgaaactgtaaattcagttatcatgaaagcagttttccccattgtaatacatttcattatgaaggggataaacaagaactaggaaagattttattgctattttcaagacccatcttttctaggatagaattcttcacttctaaggatacaggcaaaatagtatccaaaggctgagaatcatgtcatcaacattactaagtcacatgaagaatcatatatttaaaattacttgaaataaattattttaaatactgaatttttcttgaaaaactgacactccagaatacattagattaaggtcctccctagccaagaaaagtagagacaaggggaaaaaagaagaagaagaagaagaagagacaaagaaaagcagccaaaaaaaaatttggggaaagagaagttattgaacattgtcaacctacaaatatttattgaaattgcaactaatatgagaacgacaaccacagttataaataaagaaaagcgtatctatcagcatgtcatctgtcagtaattcgggcatatgttttcttcaaaaaaaacccacaatacataatttttaaagacagtttattcttaagcaaactaaagacagacagaggggtgggttttgtgtgtttgttgttgttgtttgtttgttttcattttggaccaattcagggtcactgaatcagcaatgattttcctcaccaatgcccatggggatatattaaaaagttattttttgaagaggaagtttgccttatcccaaatgttgtcacactatttctataaggtttttctttggttattattttgttgagggtaaggaaaacacacacacacacacacacacacacacacacacacacacaaaatgccctgtcctcactgtcagtggagaatccctgtggatttgtggtccttttcccattaaagtagtttcttccctgggtagtttttggaaagttatattatctcctgaatggccaagggtgagaatcttattccttccatgttctttttttaaaaaaagttaaactcaaaataactcatggcataaagaggggctgaatacatcctcagtttattgagtgatgtgaaaattgcccattgttatttgtgtcatttgagcatttcatttccataatatctgaaatgttatttttttttttttgttctatctgctcattcgatgagcttcatgtagaaagtcaggaggcagaattaaaagcattgttcttgctgcatctaaaggaagctagcaggatacttgtcattttttagaaataaatttctctctaattttttttatctggttctgaaaggcacaatgcagagagattagtttttactggaaacctgagcactttgcacctcagaaactgaaacaatcgagtcctattttctatagcctcttatataagtaaagtcaaatgagttccaagttctggaaagcaacatgaatgtcttctaacctttattttttcagaacgattgagccaccaggctgtgtaggagcttcttcttaggtagtcacaggaagattagcttagaatggatgctcagagccaagacactagagaagacaaaacccagggtggaaactggactcctgcccagcccaagggaggctggtgcaagggacagtatgtaaatgtgacagaggtaaccgagatagcagagtttttgagatgagaggtcaatggtaaataaaaccagattgaaatgatctatttcagtagcttatggaaaaaactagattgggaacgaaagtgtatgatgcatttgaaggacaatgcagagacagtaatgccaagatgtggtaatggaatgaagtatcctaccctggtcatctatgctacttcagtttacttatatgtcaaaaccaataaatggtcttttaaccaaggtcacatggtgcagaaaagtatagaggatttctttattcctttttaaagttattatttataattggatgctttctcatacggatttgaaggagaatctcttcctaaagtggatataaacatatacccaatctccagtttctttcatttggccgatcttggtggtacctctacacatgaaatcagtgacttacaaatggtatcttgtgacatgttttacacagaaagtcttcatctcaaaatttgcagttagcttcccctgctttgagaaggctgtcatgaacttagtgcagaatttgttatatatttgtttttattgtcaaagagcttccaattgagatggtagaggtttgcacactccgttagggtatgttggatcattgctggaacgttgtgaagtgacactcgatttgatatttgttgtgcttagctggattactccagattacatcattgttcttgctgaacttcaggatctaagtcctcgctcttctacttaacagatgaatctttaatattgagtaagttacttaacctaactgtgccttgctttcctaatgtataaaatggagatcataatagtacctttctcataaagctgtctgtgaaaaataagctaatatgcctaaagtccacaaaacgtcatctgacacacaactctcaaaaatcagctgtcattatttgtattatcgttgttagctttatcattagggctttatcacctgtcaattactaactgtggcaccttgttcatttctgtgtgatacagcacaggaggtgtgaaactcagggcacttgtaaaacactgcttaaatctaaaagggactaagcataaaagtagaatacacatatgtagaggcttgtaaataacaaataacctgaagggctgtggtctgaaaatatacagctaaataagtggtggcttgagcatccctaatgaagagtgatataagactctcactataccatatagagaaaaaaccctaagagtactaagtggttaacttttattcccctatcacatttctttgttgttgttgttgttgttttgttttttaatcagaattgtgtagagcctacacttctgtttgccctggtattgtcttcttaatacttccaaagtgcttcctttgccaatttcaggatcatctcctgctgtatttatctcagatgagacttttttctccagtgtttgtttttaattcttttcctaaacacaccaaatcacaaccacacagttccataaactcaaactcattttctctgaggctttatcaggaatcatctcaagattgcataacagactcacttttaattgaaaatgttgcatccttaaattcctctggagaaagattgcagtattttcctacaaagctgcttactgctagactttctgatgaagtttctacttcattcagctggctttaaagactgtacaggttgacagttttccaggtgagccgagggtctttttgtcccttagtttatcaactgaactggtattttgacaaaaaggcctgtaattcctccttatgaggttttaaaatatatgtgaatcaaagtcaggatgtttctcattgggttgtgagtttactgcaacaggagtttacaacaacaggagttgcagtaaattcactgcaacaagtactgaggagactctctctgaaccctaaattcttccaagatgtggtctgcatcagcatcacctgggcttcggttagagatgcagaatctcatgtaggcttttacatgggcatcttgcgtggagttgaggtttggggtacaggtcctgtcactcaggtagtgagcatagtacccaataactggtttttcaacacataccttcctctctccctcttgcctctagtagtccccagtccctgttgtttccatgtttatgtccttgtgtgatcaatgtttaactctcacttgtaacagagaacatgtgatacatgttttcctgttcttgcattcataaatttaagataatggcctccagatgcatttatgttgctgcaaaggatatgatctcattctttcttatgtctgcatggtattccatggtgtatatgtatcttctgtatctgtaataaaaggagaaatttaaaaaactaaaaaataaaattaaaagattattatgcttaaataaataaataagaaatgcagaatctcaagccccacaccacaccttctgaatcagagtctcaaattatttctcatggacaaaggctgactggtgaaaaacgaaacttgtgtgatgaccccatgaagtgggaccctttccatcatttttttgtttgtgtgtttgtttgttttctctgtaattgctctttttctgaggaaatacagtttgggatggaggggtggaaagaagggactctgagtatatttgattcagacaaaacttattttcttttaattgaaatgataaggggagcagaaaaggacatgcttttaaatgaaccccatgtaaagatggccattgcagaaaaagtattcaattgcatacataaataggacttcagtggcgagcatccttcttagtgtcacatgtaattgaatttggctgataaataagccttgcatctcttctttatgagaaaaagtgcttatggattttacatgtaataggttcaagggttttgaaaagttctggatgatttgcatgcagtgtaaataatttaaaaatgtgaactattgttacgaggtgaaagcaagtatactatcaaaatttaactacgatgtttacaggcaactatatttttaaatattttatttgaggattatctcaagaccagaaaggcattaacataaactacaaatcatgaaggcaggaagtgtctcaaaaaaaaaaaagtattacaactaaatagataaattgggggaaaaagattactcctgaaatgtagatggactgttattgagctacatatcctgtaatatctgaatcatataagaccactttttgaagaaaattgttttatttaaattttcccatatgattatcctactaccataattttcatgtgatgttacagggtatatattacagtggttcattatctgaaattgattaaaaataaaatggtgatggctgagtagctcctgtctggcaaaaacctctcacagataacaactacaaaccctgaacaaaatataaaaagaaattatctgaagaccctggagagagaccaagacagggagatgctagaaagaagatgagactttaaaatggagatagttgtgagtagagttcccttggttttatccctttccaggacaagtaaaactctgatagaaaactctcaattttactgacttgaataatataagacagaatttagggcagctacagctccccaaaagtgaaggaaataaatctcaaaaagaaaagagtcagagaagaggggcctcagattctgtgtatatacttgtgtgtagtctttcactgaccacataaccatgtgaatgtggagtccatgagcacatcatacttgtttaatatgtattatttagtgtatgaatgaaaagatgatctaacagccatacccttcatagagcattccaacaagctagaatacctcatatcaaatgtatttactttaagaggtctgacagagaaaacagaacatctcaaggtaggattagggcacctttactaatctttaaaggaggtttttccattgtcccttgtttgacatttggaagttgtttaacacttgagtaatgaaccacagtaaactttgttccagatgaaaagtgttcttttatgttgtaaagtgaaaggatagatggaaaaggatagcttaaagaatgctacaaaatggtgcaaatggccatggaatattcacatgccccttgggcagcctttgcctatacccaaaggcacatacgcatgcccagtctgaagaccatagcgcaaagggaaacacctgtttgaccaagactgcaggggataaatgacagggtatagcagaccttagggactgccatcctctaaagaactcacactggaaacctagaaaaacttgacaaaaatttaagatgcccccacaggaattcatccagcattgtaagttttctattgatgtcagcagcctgaccgctgcagatatgtactgatctttgtagacatttgtaagaattgtagtgctgttaggtaaaaagttccctggaatttatttgtcagatcatagataagcagctcttgtttggatacttgataaaataatattgaattaggagttaaaatgttttcaatcgaacaacgttataaacactacccaaagccttattcattttgatttaataagcaactactgctcactttctatataaatattattgggtttaagtcctgagggtggagatggaagaggcagcagagacataaaggtgatgaatcaggtagaaacatatttaacagcaattacacattcactcaatatgtagtctagatatacattaaataaaacttaataaaaaaattaacctggccaatttaaccaacatagaccacaaatctttatcattcagtctctcttaaaatgtcttttccttcaggtaaaatatttagaaattgacttattgattcttcttcacctgttcaagtaaacatcacttcacactcttccctctgtgctaaagcaaactgataagaaaacatttttagaagcttcagggaaatgtaaataactatctttaatcattagagatcatgctgaacatatagaaaagtttatttctgttttgaaacaaaacttggcagaaataaaattggcagctttgattcagtgcaaagtattgtggagttggtactatttagaccatttcgaaataatttttaaatattttatttattaatatgtttgtatagtggggaatgtggttttagttgtttgctgtaagtttccaaacatatttatttggccctctagtaactaaagaaacagagaagatactcttcaggctcttcattttgcctcagttttgtccatgcgaatttgaaaagtaaatcaacagtcagccacctcttttactgtaaagtagcctgtattgcagcccgccaaaaatagaaaagttggaataaagtagaatgtgtttgactttggcagaatctgctaatctgttccttataaattttcacacaaactgggtagattatttaatattaataacataagccccactagtctgatccattttttctcctctgacttaactgagaagagaatttttaactgtcttaaaataggctacaaaaattactttttttagaaatcattgtacatagtggcacttatttgtttatgtatctgtctccccaccggaaggtaacttctttgattgcaagcattgaactttatttttgcagccctagcccaggattggacacaaaaatgcaagcacagttactgcatcaaacttagccactgttttgaaaaaccaaaagagcttatctaaagtatgcattttaatcaaatcctggcagaatataggaaacatatggctgttatttttaattctcctttgccaaatttgttttacagcaaaacaaaactaaaacatctcacaaaattttccttaatgtgttattgtacctaaccatatgaaatcaacacagaagctgaatctaataccccagttttaccaatgagagggagaaattgcagtagttttttgtgtgtgtgtgtgaaagctaagagtttttgtgcacacgaaatgtatcatgagaattaagtataccctgaaaatgaaatatgcacaggcttggccttgccaaagttttcagagcgcttacttttggcaacacttccctgggtcttctctttgtgaacctgtgaagatggtgagtttcttaggagtagggactctgtttgacaactttggatcttctagcctactgcctgcaatacagtacaagctcaataaatatttgataaaccacattccaaatctgcattctctgtgatcccccagcccctcaattttcctactctatggtttcaaagagtgataggacaaaatgtgtgtgtagtcccttcctgaggtattggcattttagtaaggaaaacagctttaagctaaagaaatgaaaccgtatggcatgtcaggcattctgaagatgatggaaggcattctgaatggcaagatagtattccttagctccctgttatacatggtaataggcctgtagtgcaaatgatgccaagaatagttcatggtggattttcaattgcttaaaagtaggacataggccatgatcattgcttttcgttgtttccacagatcagctctggtctcctttctatttctcatacttaaggtcttcctctatttctcatacttaaggtcttcctctacccccaccacaacagaaaaacacctcaaaacattgattacctattataaggttggtcttgtttctcaaaaacaaaaattccaaagcagtttacatttggaggcactctttgctatcgatggttcttgaacatattgccacacaagatttcctatgttatgtagattagaggaattttcttaagtgtccttgaaaaatataataggaaataaattcactactgaacatctatcttctatgaagttttgaggttgacttgatgtattagactaaggaaaacctgtgttctataattctgattccatttttaatcaaattattataaatgccctttggggcattttgtggaaaagatagattaaatagtgtacccaattaaaaaactgaaggatcccttccgcttgaaagttacatactgctcaacaaactgtatgttttattaaaacatgaactggtagtaagggcactgaatagtgatatgactcattgaagccaaagtggataatatggctttcacttacatatcattcacagtggcaattatctctttttatattaatgaagaaaataaaatagagtataactcacaaattttatctatttttggcttcaagtatttcttgttttacttggaagtgatgcatttatattatttgagtgcagatttttgtcttgcaatttggaagatcatactacttaaacaaaattacactggtgtgacttatctttagaaagctagtggaaagttgcttagcttatttgatctgatctgagtgacttccttaataccccatgctgctaattaagaaaccatctcagaatgaaggtaaggactaaccctaatcaagaggccccatcattttgtttaatgcctggtttactccacccttgacagaaaggttataattaagtcaggggctatatgacaatatcttattcatgttgatactcccagagctagcttagttcctggctcatagcaggtgttccataaatgtttgttgaatgcaactgaattaccttgaatatcttgggcacaggattcttaatcaggggcctaaattagaaattctgaaaaatagtttgaaaacaaaaagagagatgaggtgtggttctgtatatttcttaaaaaattatcaggtgacactgataaaccaccttagttatgaaacaccgatctaagtgctaaactatttttgtgaaaaattctaatagtcagcttgatcacctagatatttctaattattttcatgaggtgtttcttttaaaaatgaatagactggtgatttttaaaatttgtgtgagcttttgaggcctttagcctccaagcaatatcttgcgtcaaacccaaatatggtcaattctcatttttattcatgaattccacctttgcaaatttgtcttttcctataaattgtttgtaacccccaaatcaatactcctagcagatttgctatcattcacagacattcacagaatgtccagaaattggagccacctgatgtacagctcccagctgaggttaaagaaggcaatgctctctgtgccttcttgtttcagttctcatactacgaacaaatgtcctttttgtggtctatttagtgccacaatttttacatttttatgaatttgtaaattggttggtgattttattgttttaaatagcccctcaagcatagtactgaagtgctgtatgatgttcctaagtacaagaaagctgtgatgtggcttacagagaatatgtgtgtgttggagttttcttcaggtagaagtaatagtgctattggttgagagttcagtgtgaatgaagcagcaacatatgttaaataagttgtctttaaacaaaacacataaaacaaagttagctattgattgctgggtgaaaatatttgtgaccagaggcttacaggaacctaaccatgtgttttccctagaagcaatggctcagtatttgctatttcagtttttgaagcaactttatagaccataactactgaaaataacaataattaactgtatataaaactggaagccaaaattgctctgggtgacaaaggcataagaccatcatctttgttctcttcccatctccttctccccaagtgacagcctccaaaacatatgcttaatttctggatccagaaagaatagggcttttaaataagaatagccttccaaatgaatccagagtaacaactgaatttcacattttatttatatacttgggtgttatgtaaatatagcaagtacttgcttagaaaatacaaaactaacattatattaaataatcccagttaggaaggtaatcagatgggggggagggaagccagtgcttttctgagccaaatataaattacttttagattacctggtgtttttaattatctgcaccactgtaccactttggtcagaatcagaggttgattctacctctgacaatgccatatctgccttctcctgggcccagagggcttttccctatgttcaataaaccttgaaagaaaaggaaacacagtagaatatctgttggctcagcacaacaggttttgagtaaacgaattactactcttatgcattaaataaaatatatggttcggaaaaggttgctacagtactgaaagtcacttcatggctatcttgctttttaaggaaaaggcctaaaatgcagtcaaattcaaaataaagtaagaagcagcataatgtaaaacagagtatttggtaaaataatagtaatgcaaataaccactccctaatacctaagattttgaatgctaaattccgttgtcattattgttgttgttaagacataagcacagctaagtaccctcagtcacgcatcctcaactggggacattttgctccccagggaagactgggcaacatctggagacatttttgattgtcaagagtgtgtgggagatgccactaacatctagtggatagaaattagttatactgctaaactcccaacaacatacaaggcagcccccgcaacaacaacaaaaatctactccaaaatgctaatgtaccaagatgaaaaatcctattccaggagtgactagtaaataaaagtattccattatgcagtacaagcaatggttatttctatacagacaacaatattaatctgactcttccaagggtgtggctcctacgtctgcattgagttctcagcaaggatgtcatcctaatctctgtgcccagagagcgcttgatcccaatatacaaaccaaggctcccatatgaaaacaaaagcataaacagcagctaggctcagcgtatctcctgggtttatatatgaaatttatcacctgactctctcctctttactgctaaaggaacatcatcaacaaatcagtgaatttcagaagcagcattaaaaatatctgcgttatttgcttcactggccatagaaaaggggccataaaagtcatgcatcaaatccttagatggtgcctaagattatgagtctgacaaattgcaggaaaatgaacccatctgtgtaagtccgcagaatgcaacaaggaagaacattttgtggactagttttccactggcttatttggctatttacatgtaatagcagtgatctgtgcattcactctgatttgtgggtatagcaggtggcacatgtttacagatgcttgggaaactgccttgcaagctgaatgcagatactttggcttgttttcacatttgctctgtgctccctggcagatctttacctgtgtctttctctgagtatcttcctttctttctgacaggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctggggtatgtattttctgcagctaagttttgagtcactttcacctctgtctgtatgctttcagtcttcttctagtcttggtctcagagaatagagtcaagtcccaggtccttcaaggaatgatggaacacaggtactggcaggagttcagtctccaaaagacctgtggaagccctttaacaatctcaactgtgctgaacatgagggtctgcacagagaaggaagataagggtgacttccaaagggtaacttcaggaaacaaacctagctaatgatggacacaaaatgtgtcctgattgagagaagatctgattaggcctccttctgctttattcatcacatgtttgtagagcaaaggagaatttcacattttgaattatgtacctcccctaccctggcttcattttccttcatcaagaacatttcttcctgtcaatccatcatcaggattcctccagtgaaagctcaggaagtggagtccagctgagaggcagatataaccacacgggcttccaagtagagcctgtgtgacatcatagcacatggcattggctcgggaaagcttagggctggattgtttaagctgtggctgcttccgtacaaactaaggcagggtgctgaagtccttcagggatgctctagaattgctccctttcccccagggctgctgaaagtccagctccccctggtggaagggaactgaacagaaggtgaggcaatgaaagaaaataaatgctgcgataaaaacacatgctgccttatcaaaaaaaaagtttcagccttaccttgaaacttccataccagaggaggaactcgtgggccatccctcactgactatagagccaagggcttctctcaccacatccaccccacatgatgggtgactgtgactctgagagcagaggctgtggatggccttcaactaagcttgccctttaatgcagcaggctggggagcccctacaagtactggtaagagaggagaggtgtagtgaggagggaggacaatccaagggattttttaaaaacatcaccttttgtatttaaagccctgcccaacaggcattgtcgccaactttatagaaatgtgcttgggaagtcatataagcagcctagagtctttcctgcagtctgtaaactgcagaaaggggctggtgttatgccatactggtttccataacacccttacataacaggggtacatggttttaaccaaatgcattgcccaagcccaatgggataatccgataatggtgggtcaatggggcagataggcgggatgcctcaaaattgaattgatgatgctacaattatttggttgcaagcaacagagtaagatgttctaacttaagcaaatacagagaagttgtcagaatctagcgtatctcatggaatctaagggcagaaatatagccaggcaactaaaagggctgtagcctgggagcagataagccaggagctctctccctctgccttttgtctttgtttttccttgcatatctgtttttacccttctctttctttacaggccatagaccatagggtctctgctccctccagttttcatagtaaatacatcctgccccaaagtttcctgagtacacatgtttctgttccaggcactcacagaaactaaatgcccatctttaagttccaattctgaatagcaggacaagaaaatctgattgatccaactgaaggcaggtagcctaccctggttcaataaactgtggccaagaaaattgagggggatgttgtcacatagtgtgaacatgtctagtgattgtgaaccctccagcaaaggactgagaaaggggtctttgtgaactgtacaggctgtctaggatattcaccagatcacctcatctgcatggctgctcccttataaggagagcagcgctgcaccctgtttccttaaccatccagtgaggttagaaatcaggctatcactatcctgctggttccacatcaggtaacaggttctcctgctctttcctgtcctaaaacaggtcaaaatttactcaaaatggtcttttactatttttttttttctcttttagccccagccttccacagagactaatctttcctttccctggccttctcatccgtatgtacaccctctcaacaatttctagatttccaaatctggtcatgctaagaatagactggatacaatttaatcactgcaatggcaattctgatcatcacaatcataataattggtgttgatcaaatgccttccagtcaaagacctgaaaataacattccaccccaaacacacacacaaacacacacatactttctgccagatttatttcctttgaaataaaatctgtggtatatttcttttaccagttttgattgttcaaaacatctatctgccatactcagaaaatttttcatgggaaaaaaaggctgtaaatgtattcttgtcggtgacattcagcagagacaagggcaccctggaaggaacaatttatactgctcttggagtatactgatgcattgtgaattagttataaaactttttggcatcatcatagacagctcaatgaagatatctgcttaaaacacataaacaattcaaaggaaaaaaggaacaagctgctcagctgtatcaaaaacaaaggcaataataataagtaaattgtttatgtgataccttaagcttctgtaatcaacaacaattcgaatgattcaagtagaatcccaaagaacattacacttagtaacgtaagcacagaacggggagttgctaatcaatggttatacagattaagtaatgcaagatgagtaaattttaggtatctgctgtacaacattgtgcctataggtaacaattttgtactatgcacttaaaaatctgtttagagggcagacctgatgctaattgttcttgccagaataatataaaaatttaaattaaaaaaagaactagagggatttgcacttccgtagatggacttttggaaagatagtcaaccaaatagttctaaaatgtaatgtttttagcatgccaaagctaagactatctttctacatgcacacacacacacacacagacacacacacaccaaaattccaccaaactcattaccactgaaaaatcacattgccaaatctgaactctgagaacaaaattgacatattttaaagcagtggctcctttcttagaattttaagcaagcattatctttggatgggaggaaaatgggtgaaattaataccaattaatttctcaagaaaaaaatagtttcacagaaactttataaagtttaatggggcaagagaataagtctcttctggataatatttttattgtcctttgaaaatttttttcacatgaagacagtatgataggttctaaattttacaatgccagaaaagaagcaaaacctacatacttttaaaagattcttgaaagttagactgcagaaaatatggcccaaaaaagcccagttgtattatagcacctaatttgtttgcaggtgatgtaaagcccattcatttaattcagctgtgaataatgtttccaattctaggatttgaaatgaatctcaaagaatgataagagatattgtaaacattagccactgggtgaacaagtatctggtggtgaaattctccccaacagaaaatcaaagaatggttctttcagtagttattcccttccaagtctgcatggcaccacttagtagtcgatttctctccaattgaagtaacttcaaatactgaagtttagttctcaggaagatcacttattttgcagccctctccagactgtttctttgccttgccttgctggttttccccttgttagaaatcaaaggaaggaaatttcccccatggacttctatattgaacaaatagaatttattaaatccctcttaaaaaatgaatcctacacagacaggattattctgaatctcatcatctttggtgggaagaatgggttgttatggatcttgggaccttggggagagagaaagaaaaaagaaaaaaaaacagaaaaagcaaactacctaaaaggaggcatcatagctagaagaaggcaaagagccctgggcgttaaaaggtgtggggtctatactcgtctccagatgaagtagaaagcactttcctttctacaaaatgatgaggtgggattcagttttccatatacttctctttctctctaattctaaaatatccatctcaaaataaatccagagactttgtttctctttctgagcccaagtgggaaaatggtatgttagaactgctgtgaataacacaatcatgttttgtataagcaaactcaaaattatttcaggccaaacattaaatctgtggtcctattgaaaatatgcttcctgggtttaaaagctgaggttgttcttaggtgaaaattcaatattttgagacccctttttgtatataactcacagaaaataaaaatgcattgatttaattctttcctaagacacatttcttaatctgatgacaataacaaaacctctttctacagatgtctcaatcaaatcaaacaatattctactgttgtacatctgagtaaaaagacttattttttcttttttaatgaaaattacaactttaggttatactacagaataaaaattgatttaaaaaattataatctggaaggacgtattgcaataactgtgtccatttttctgtttataaattaaaaagtttttttttttttactagcactttgagtttagtcaaggaggtacagtaagctgccttcataaagtttctctagccagaacctacagaaggtagggaatgtactggcttctctgaagtattcatattaaaaggaaacaatcactgcatgagatataaacagacagaaaaacaaaagagcctagaagaaagaatgtgaacatcagctaaggctttaggagcaatcagactattgctttcatacaccgtcccaggtcacatccctccggggtgacccagctcctctccataagagaggccagttcacccacaatgaaaggctttctggtctcagttaatagtcatcattataaacataacaatggtaataatagtcatagtgtacctgctacattcagcaatttgtaaaaggcttttaattatttggatgctcttaaccaaactctcaggaagcacatgatgttctaactgggagcattttgactggcttgaccaaagatgatttttgtgaaaatatcaggggaacatcttgacagatgcactcaatttgccagtatttttgcaagtacactaccattgtccatgcagctgtacttaaaggttatgaccaagaaaccaagtgtgatttgtacttttcacatttgtagggttcccgctggtgccaaccactatccatgctattaccagggccgtgtacttcaatgacaagtaagtattatggtgatgtttaagttaacatattcataaacaaaatgtatttgtgtattaattgtccccttgccctttttcagctgctggctgagtgtggaaacccatttgctttacataatccatggacctgtcatggcggcacttgtggtgagaattagttttttattgcaatattagtagtattatctcttagttgagatttctgtgtatatagttctatgtatcatatgttttataacttcaaaatgaagctaatttgatggtattctgtagtaaaaaaaagcaatttgattttagactcttcaaaaaaacgccttttactcacacatggaggggttatcatgagctcattttcattacagactcacactataatagcaatgtagctcatattttaagatttttataactagattctcctaggtaaaggtgagaggccaaggggctgcaagaagtttgtttgtgttatgaacatctagggtctttgaaaactttgacattccagagctctaaaagtctttggttctgtgaacttaaggtccagaaatccaaatattcaacacaagctcaattagtgagttagtaataaatagtggactcccagccaaatgtcagatgcttactgaggatgctacagttcttacttacctaggattcagtagacttggcctcatgtcttagctctatcatctaccagctctgaaaatttagataaatcaattaacctaaaaatgtcccctgatttttttaagggaaaagttagattaaataatctttcaggtacttttggaagataatctctaactctaggtcattaaaacttagtactgctccatatctttatctgttaaaaataacaaaaataataatagctactcataaattcacgattataaaatatctcctaataaaataataaataaagtaaaatgaagtaaaaactttagcaattattcctatatttaaaattctaaaatacatatttcttgccttaattatctagaaatttttaaggaaatgcagattctaggatccaaattataaatgtgtatctgagttgagtatatgcatacttcactgtgaatgaccataaattaacagaaattgatatatttggaattcttattaatttcatgactaaaggaaatgcacattagtgcatttcaaaactaaaaaaaaaagattcaacaattaacaaggtgaatcatttataccttaatagttgatttttctcattttgaaagagctgcccgtgcaaatatgggcacttgatttatgacagcagcacttttgggcagaggaaggagatggtcaataagatatacatacagaaaaaatatcaaacacgtatttagcaactgcatatgtgtggggaaaaagtaaattctgattccttccacaaccagacaccaaaaaatgtgtttttagtgaactggaggtttaaatgtaaaagacaaaacaatagaggccccccaaaaagacacattatgttgagtatcttcatgagcttcagatacagaaagatttctaaagcaggatacaaaaggcacttaaggaagagattgataaatcagctacattaaaatgaagacaacatttaaagactgaaaagacaaaacttagagtccaagaaggtatctgcaatgttccaaataaagactaataaatttatgaaaaagtgttcagctcatgtatcatcaggaaaatgcagattaaaacaagaatgaggtaatactacacccctccaccacccccgccatagaaaggctcatattaaaaagagtgttcataccaagtgttggcaagggtgatgagcaactggaactgttttatatactgctggagggaacataaaattaaaccacttctctagagccctagaaatgctgagccaattgtgctacctctcaggtagactctcatgttctatgtaggtaacatttgttgctcacactggataaacaagaattgagaacagtgcatattcttaagtgatacttttctgtatgatttgctcataacaccgtatatttgcaggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccaggtaaggaagccaaaggtgtatttattcaactactgtgcttattcagctagctgattttaactctaaagcccatgatcttttattattattttacttatttgtttatttatttatttatttattattttattttatttttttttttttgagacagagtctcgctctgtccaccaggctggagtgcagtggcatgatctcaactcactgcaacctccatctcccgggctcaagcaattctcccacctcagcctcctgagtagctgggattacaggtgtgcgctaccacgcctggctaatttttgtatttttagtagacggggtttcaccatgttggccaggctggtatcaaactcctgacctcaggtattctgcccgcctcggcctgggattacaggtgtgagccactgcgcacgcctgacaagcccatgatcttcaatgtcataacatttaagcctccaattcaataagcccagccaaaattctgaaggacaccagtttttttgaggctctttgttgctgtttctttctgtgcctgctttcctgtcattcccagggccctcagctggtcccatccaggcatgttctccttggtcatagatacagaaattgtcagatcttcctttataaataagtgctggctctggggtaatgaggaatttgcacaaggctgtccatgcctcctgctctatcactctccatttgtcaggtgaatgttaggaatccattcatgacggttcagtgctataaagggaagttgtatccaggcctcccctcatgtaagagagaatgcagtgggctctcaggggctgtcctgggctgtccagtgtctgccgcactggataggagaatggctgccctagttccattcacctttacccagatctaaagccccattgaaagcataatgctgtatttggatagcaagataggatgtgggagtccttggcaggagtaattctatcacaggctcttaggccagagttttgctgtctctattacaaatttcaaaatagttttattttctatattaggcttaatgtgaggaggaggtcaaaattaatagggccagaaagaaagtttagggatcgtttgaatagttcgaactgttcttttagccataatcaaaacttgggcacaagaaatcttcaagcagtgaccaggactcaggcagtttcttagtccatgtccttatctgagcgatgaacttggcggtgggtacagtattgcactagttcaccatgacaacataggacacagacccacagcctcccactatgacacttgtcttgtaaaagatccctctactgaattctgcaaggtctccatttttaaattttctaagtgtagtttttttttttcaaattcaccataatcagcatatgctgctataaatctccatgttaaagggagcaaaatattatttagattagcaaaatattaatccgtccttctagccaaacgatggaatcctaacaagaaaaatatatttctaagggaatattcttatagtgcagcactgactatgaatggtagataattctttttcttgctttttttttttttcatcaggccttctctgggcagtctattatattgtttactaaacaacataatgcacacaaaaataacttcaactgtatttttccttccctttttagggcttctttgttgcgaccatctactgcttctgcaacaatgaggtaagcatgcatttcatataatactatcacttgtttgtgtaaaggcagcattttttccaaagggcctctgtacaaatttcatttcatctcacttctacagttgacctcatagggttttgtgattagcaacatgatgttttttccactactccaagctgaatcttatccatggatgtgtagtacaatggcaaatatgattcagacaggcagttaatttccttgggttgcatcttgaacagatcagcaccctcaggagcaatagtgaaagctattctggatgccatcacaaagagaagtcatattcctattcccttcggaagacccgagccctcactagggcagagacaatctccattcggtttgtactagttcctcaccttcttttccagttgcttggtgctaacgccctactacttactcagcgttttgaaaatcaccctgaagtgaagattcaaaaaggattctcaaataatctacaatgtgaatatttagatcagtaaaatctagagagccatatggctgatccattctgttctcagggtgtttttagccagagttaccctttcttccaaccaaatcttgcctgggagccaaatctataaaacataaaaatggagcttctatagctccagacatccttccaaagaacttccagggttttagggaacatgattcaaaatcttcctcatttttcagggaagaaatctgaactccagaaagatcatgtgatttacccaatgtcacaaatgcacttatggttataacccagactggaacacagatttcctgtttttcaattaaactgaccaactcccaattaacttatctatatctataattccttcctggagctatgttagtatgttttttctaggaccacacaacttttaatgccaaagcatttttgaacattttaaatcaattcctattaagaataattccatacaaggcaaatcacattttgccaagacatcaatatattactttcctattagtaattagaaacatttctagccattgtcagttgctaatttattctctatctttttactaagttaaataatatttagtgagcacctacaatattttgctattctgtgacctgttcatacccgtttccaaccgcaacatgacaaagtttttgttgttcctattctccattttagttattacattttattcctttctttcttcatccattcacctaccaactcattccttcattcaacaaaaatacattgtgcatttactattgctaagggctagactaagggcctagaatagaaatgaaaagacatccttccattgcccgctgttagagtggcaatatttttagaattttaatattttttagaatgataaaaactaataaatgagtagggcgtaagtcaccccgtgtttatatcaatttctgtgaatgtatatccatgccttttgggttgtttcaggtggcatgcaaaataaattttttgtctaaaataatatcaaaatagagctaatatgagaaatcaggctcagtggggcatacctggaaaaacacaagaggattgcatgcattcgtaaaaataccacaatatttattgtgtcttatctatgatactgtcattggaagtgtcagacatagaaagcaaacccaggggtaccctagcaattgaatgtctcgagttcatttgactatatgttatctctgattttgaagtaaagaaaccatttccattttcattaagatcccgttactgggggaaggtaaaagtgtgacatttctaataatatagaattgtgtactgtgccagatgtaatatcacagacccatggattttaggcatctgggtctcagctggtcattctgcgaatgcatcaccttacaatattgaacacaggcagggcactcacacatgcaggaagttatttccagctgcatctaagatagggctgtgatgggatggtgcctggctgaatactgagttttagcagaaatctagggggctaactcaacataataatgagatcacatcacattgtgttatgtgcaatttaattttgattatgattggtatgttatcagtgaaattattatttcatttttgaattttgattcattattggtatgttatcagtgaaatgatcattatgaaaatgaattatatagagagtcagtgggtagactagaagcaggaaaggaacttgaagaattaaagtaatagaaatcaggagaggaccatgagagcatgcttatgtatcaagcatttcctacaatgactcttccaagtgagtggacattgattatccaaacatatcagtaaattattaggtacctaagagacctgaaaaagatgattgcagctataaaaatgcacaatttgtttccaagaagtagcatagaaatgaaagttctaacaacacactagattttctcccttttcttgtgtctttctattctccgtacatcgtggataaaatagtttatagaaggaagtagcatgatcagaaacatctccatttaactgtcacaaattggagtgtgcaaaagctaaaattttgtttatttcctgtagcttatcttgctttcaagagactattccaccagcctctagtggtttacagcagtctctttatagaaaatattcagtcaattcaaaaagcctttgtccaaaagagcaactggctaccaagttttaatgccagcacctgctgttgaagttcacgctggttccccttactactaagccctcgagaagtcttttcacctgtggcctccttgatgaagccacagccctattctgattcacaagttctttccgccaagccacccgaggagcctggaactccagctcctttcttcacaccacatagagcctgtgaatctatcttcagcacatgccatagccgttgctgctccgctgttggacatggtgccaggggcaaatgtggagtttcttttcagggctggctattttcaggactgtgctctcgaaacaaaaagaaaaacttgatgtaatggagggttcctaagaaagcaaatgatcttttgcttgatttcttctgcccattttcccaggtactcccaccacgaagggaaatgcaaggccatttgtgtgtctttctctcctcttcctctcaggcctcttggggctgtgcactcaccacttccccttcctgtctgtgagggtctctacctatatcatattctacatgttctctaccctgtagcttttagtaaaacactatctgcagaccagtaagattttcacaacatatgcaaagagaagtttcttctgtttagaaattctcccactcaataaagcctgattttcaatacaatgtctttctagagacataagaaagccagctttgagtctcaatgctaagcaataattttccttgttctagaccagtattctcaaacttgagtgtacatcagaatcacctggaagatttctgaaaccagggattgcttggccccagcagcagtttcctattcagtaggtctggggtggggtttgagaatttgcatttctaaccaagttcccaggtgatactgatgctgctgacccagagacttcactttaagaaccactattctagacacaatcacacttgttcttcaagcagtggatgaccttgacttaatgaactggggagatgtaggaaattttatttaagaaaattaagaaatacaatggctgaatgttttcaaaaagtttaactttatcataaatgatacttaggtattgttaccctttagagcaaggaatcttccccaaacataagaaaagagataatgaatgggaatcagaaagctctgattctataatcaagtactcaactcaaattatagagcatataaattttgtaagataaaatcagagaccagtagagatattgctgctatggcctccgaaagactgaaaagaatgttgacaacaactttgtaaataatattcacaagtatcccttagcatctaattaatagggcttaatacgaatctagctttcagaagttgtataaaaccacctaggccaggcgtggtggctcacgcctgtaatcccagcactttgggaggccaaggcggctggatcacaaggtcaggagattgagaccatcctggctaacacagtgaagccccgtatctactaaaaatacaaaaaaaaaattagccgggcttggtggcaggcccttgtagttccagctacttgggaggctgaggcagaagaatggggtgaacccgggaggtggagcttgcagtgagccgagattgcgccactgcactccagcctgggagacagcaagactctgtctcaaaaaaaaacaaaaaaacaaacaaacaaaaaaaaaaaccgtctaaagtgtgcaattactttttaacttctagggaatttaaagtgtttttttttttttaatcatgatttttaaatgtcaagctcaggttgcagcaggtctgttagattgtggtgacagtgtgaaggagtgggcgttacaatctttgcattcattggatcaaaactgcagaggtaaacctcaccttctattccgcagtacataactatagtaggtacttagaatgaactcaggaaaagaaaggcaaaagacaaaaacattcaaatccaaccatgaagactctaaacttattttgttttgtacaaatgtaggaactgaggcctaaatatacaaaggccaaatattacaaagcttattaatagagccaggtataatagttaagtcttcaaactgtgaggccagggctctatttttataagttggcaatacataaatagatataatcaggaaaaaaagtaaagtgaatagtgtgtattgcttttttagtgagtgatgaatttatataattcaaatctttttgttgttgttacatttatcccacttacaactgaaaacatttattttcaggagcaacaaaactctccctgttttgttttgttttgtttttcagattaaatgcccttattcttgtcatcagagcagcatcagactcaacctgtgatattgtaggagataattgcccttattagtctataattttttaagtgtcttttttatgctgctaagggcctgttattatatgaatagtttacaaatcaaagcacattgccatctccacacaaaaggatgggttgtaattttggacgcaattaaagaaggccgtgaacctttctgtaataataacttttaaaaattaaaatagaaatcaaaccgtttggccccatgctgggctgtgtactttattaatataaatggatactctatgggagttattttaaaaggacaggtgagaaataaaagacctctttttcatgctgcatacttttgcaaactaactctaaactcataactgcctgcttggatacttgtaaatatctgtgtaagtttcagctacaaggataatcttggtatttaagagatgctgaatccgtggaaattatcagcttcctttttttttttttttttttgagacggagtctcgctctgttccccaaactggagtgcagtggcatgatctcggctcactgcaagctccgcctcccaggttcatgccattctcctgcctcagcctcctgagtagctgggactacaggcgccggctaattcttagtatttttagtagagacagggtttcaccgtgttagccaggatggtctcgatctcctgatctcatgatctgcccgcctcggcctcccaaagtgctgggattacaggcatgagccaccacgaccggcctatcagcttcctttgactggagacattgcttctccaaaaatgtgctgaacctgtatatttcccagtttctcaatggggcatttgatggttcctagattataaccctggcatttaaagctacggtaatagtaccacccaaataaagccaggctctgcttggtactgtggctttgccacattctagctatatgattttggacacattgcataacctcagtgccccatccataaagtgaagatagtagtgcccttcccatagggctgttgtgaggattaaataagttaatacaaatcacatacttatgatacggtacttagtaaacactcaataaacagctgaaacttgttattctatcttttgttcttgcgtggcttttttcaatacaactttcagctgcatggtccaccttattccttagcacttaaagtttttgtctttgtccgttttaaatcactttagatataaagtacccttcatgcaagcactcattaaccccaaaacaaaataaaacaaaactcaggatgtgttgcctccataatctgaaaagtctaatattccaaattatcagattgctaaataattctgattgccatttgtcacctcgaaccttacggttgctgtgctgtgtgaagataaactaccccctttagttgctttttgaggaatcatttgactttgtctttctctgagtaaaatctttaaaaatatatgaacaatactaattattctcagaggagattattactctactagatacaggaaaaaaaaagtatatttgccacagaaccattcagccttatattatacatatagttttataacattaatcagttttgctgtcatttttctcatctctcagatttgtacaaatgtaaagtagataaaatgattccccatgatcaagtagttacatgatttagttcacattatatattccccaggttctctctcatgtgtttagctgtcatatgtgagtttggcagcagaatgaactaaggatgtatcataaattgatgcaaatatttttatgtaagcttgttgtatgtactgagcaatagaaactcagaaatacagaatagagattattgcaataatctcttttttagttttgttcagctatagagaaaagcaagaagtttggagacaacaggaaggaggaacttaactactaaattgaattcgtttctataaaaagcagagctagacaagcaaattcactgtctgtggtactgttttcagttgtggttattgtagttttcatatttagagctttctgatgttagcatctttgcctcttgttttcaatatataatttatcgtatttataaaacaagtctggcaagtttgtttacattttagaagtctttcaaaagaaagagaaaatcttattcttaaaaagttgtcatggcattaaccagagatgtatctggcataacccatctcaagtcatgtcggacaaggaaaagttcactgtacgaggccattatcataaaatccagaactgtgctatggtttacatatatatttttcatgtgcacacttaaattaaaaacttctgccttatcagggatggtagcatataaaaagtttggtcaacctttctccctattatgacatgtataccacattacctgtgaaaccaaatcaacttttattcattggatatgaaagctaaagaaaccttttcttaaaactagcaaacaaccttgccaggggtaatttaagcaagtaactcagttcttccatttgcaaattcttcttccaagttgatatattctgtggccacagcatacacagcccagccctttagatcagaattacaatttaactttctttaaatctgataagctctaagaacgatgttcgtacactttgcatggatcatttctgactatcatataaaaacaaggctcctttttctcttccaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttgaatgtgaagcaaacacagcatcgtgatcactgagccatcatttcctgggagaaagaccatgcatttaaagtattctccatcctcccaggaaccgaacatatcatttgtgaagaattattcagtgaatttgtccattgtaaatctgaagaaagttattcttggtactgttgctttgggagacagtctaggaatggagtctcccactgcaacttgtgaactccatcattcatccaggactgagatgcaaatgtcacagtaatgcaagcaaagtatcaaagaaaaacaatgaaattgacctagttcagatacagggtgctccttgtcaatactgagccatttatacctttgaaatattaaaatcactgtcaatatttttatttttaactctggattttgaattagattatttctgtatttggctatggatctgatttttaatttttttaaatttcagtcaattctgatgttactgagatgttttaccatccttacaatgtaaaccacatgaactacgtgacctctgcaagacaaagcggctttctaatagagagattagtaaatatgtgaagaaaaagacctgcatttggcaggaagatgtatgctttgaatgcaaaagaaatttagagtcaatttgctgaaaacattacatgctcagcttggttttggacaagcctgtccattgggcaggacctagctgttgtaaagaattggtcttaatgttgaatgtattttggttgctgatgtttataaactgagaggtcacaaagaatctatcactaaaaatttttacaaaactgccaaaaatataattcttagtggaagacaatactccctttaaagagagtttgccactcccctaaactccaggatttataaagcaaattactccaaggtttataaagcagattacctcttgcccttgggtgctatctagcagtaaaagataaatttgttgaatattggtaattaaaagactccacataagtccattaactgctttccacccagcttcaaagcttaaaaagagctcaggcttttccaggaagatccaggagggctaattagaaatcaacttgtggttgaccgcttgtttcttgttattaccaaaacaggaggggaaaaaattaactgctccaaatttaaccataaatcaattcatgtttaacgtttctcattaaaatccagtattatattatcatatctctctttacttcccagtataagatttttgaaaatcctgaataaaccagtatcgttactggcacctgaaattaatttgtgaatttgcaacagtaatcagagttaccattatttaatttgtatgctaaatgaggaggtacattgaaaccctccaaatctccagtctcatctatgtcatattttgccactgcctttcagaagtgatttagttgtggaaagataataaattgatttgttatggttacatatttagcgcacccagagaaaattaattatatttctacagagaaaatgaatttgggatactaaagtagtttaagtctcctttactgaatgtaagggggggatcgaaaagaaggtatttttccaatcacagtgttatgtagtattgttctatttttgtttacaaacatggaaaacagagtatttctggcagctgtggtacaaatgtgataatatattgctaaaatattttagatgttattatgctaatatagtaggggttgaagaaaacaaaatagcttattatagaattgcacatagttctgcccaaattatgtgaaatgcttatgcttgtgtatatgtataaattaatacagagtacgttaaaagcaaaaagatgtatatttgcatatttttctaaagaaatatattattcatcttttcattcattcatctcgtctcctgctcattccatgctgtttttgatttcagccatgggctgctaccatcccatctcatttgtactgtaggagtgggaaagataatctaaaagcataggttagaaaccatacacaaaaatatcaaggttattatctttattagtacaaacatctttagtctcaatttgattgtaaattcagtgacactgttctcatgcccttgataacacaaaaccacacaccagtgtcaatcaatattgcataggtttaggaagcacagcaaagaaatcaagtgtaagaaagtattatatccttttattgttcttgtttttttattcattattctgggaccagacttgatctgtccaatatcacatcagatccttagaattgttacaatcaatcattggcttttaatatagtttggaagagagactaaggctagacgaaaggcaaccaattaactatcattagaatgcataaagcccaccattggaaggattttcagatctggaaagcatgaaatggaaaaaatgaggattaaatgagaactctgatggactaaaaaggggaagaggcgcaatttgtagattcttctcattacgtgagaacatccaaaattgtggcctcatgagatctgggaaacttcttccaaaaggatatgtaaggattacatctttcccttacattccacggggaataccgatagatattatcattgtgatcttgaggaacaaaaacaatatttcgcatcataccataaaacatgattcctcaagagataagtttgtactcagacggtcagcttcccttttgctttgactcctattttttgatccaaaacaggcctttaggtgcaaatgaatattacagttactgcaggggaaaatgttggaaaaaacatgacaaaaatgctatcatccttgagctacaatcattctcattcattacttcgttcattaaacatcgattcaacagatgtttcatatgccttccatcctgctatataacaaatatttattaatggtagttatcaaggcaaacgttctttacagtagggactgcttctttttggtgcaggggtaaaaatcaaaacctgctaagtgaaccattaccctaaaaccataaccactgatatcttgggggtggaagagcaaagtgacacatgtggctggaggtggtagctgagtgtgatcttccctcctcattaacactggacataagagctctagttgtaagaaacattctcagaacaagatctcaggacaaagtctcaagcaggattcactttcttgacaacaaggtctacaatggtggttctttcattggttagattacagcttaactagttatcacaggagttaacacttttgggtttaaaatgaaattatttatgaagagggtagatcagaatccatatttagaagagcaatcaagtaaaagcaggaaattctatttgctattttgacagagtaaacaagatgacattcctaacttaagcttatgaaagttgatttactgaactaataactcgtatcaagcaggaggttacaggaaacaataactggaaacatgcagaaaaggatgataatatgtgcatgtgagggcaaaggaagatagagaagcaacatttgcaaattaagaactaactatttctgattttttttcttctggacgtgaaattaacattttttaatatctctgaataatatgaagcattgaaggaaagaaaacacagtcattgaaactgtaaccaaaaaagaacaggaagattttctaatatcatatcttcctccattcagattagcaagcatctctgacaattttcagagattttctattatctgaagcattggtcagccagtctcttaagtcactaatcaatgcccattttccatttacagaaattcaatgccttctatctagttttcccagaaatccttccaatgagacacaagctatgccatccctcttcacctattgaccagcaatgtcacctcatgtcacta

SEQ ID NO: 39 - DNA, 54780 bp, Human
attgattcaggcactggtcagaggtcacctcctccaggaagccatccctgaccccagggaactgacttatctttactgtcacttctgggggtgggttggtggctgtcttgctcacttggttgtaaggtctcagagggcagggattgtgtctgtttcatgtcttcaggtctgcgtcatcagcgcttgtcacaaggttagacacacagtaggaccaagacagaccaagtacatgaaagaatgattgacatatgggccaggcgtggtggctcacacctgtaatcccagcacttcgggaggcagaggcaggcagatcacctgaggtcaggagtttgataccagcctggccaacatagtgaaacctcatgtctactaaaaatacaaaaatgagccggacgtggtggtgcacgcttgtaattccagctactcaggaggctgaggcaggagaattgcttgaactcaggaagtggaggttgcagtgagctgagatcacccactgcactccagcctaggcaatggaatgagaccccatcttcaaaaaaaaaaaaagaatgattgacgtgcagtggcccctgccctgggaagccaaccctcaccctccaccacagcacttgatcccattgggcagtccttggcttccaccctcaaactgagagctccttgagggcagcagggggtcaaattactctctgggttctcagcactgcccagtgtgagtccaaatatctcccacctcccctgtctccgctctttcctcactcagggctccacagccatgccggccttcagcaattcctcctgcaggctgagctggttcccacagggcctttgcactagctcttccctctccctacacaagtcttcccccataggctcttcagagtctcagctcaaatggcctctactcaaaaagcctcttccagaccacctgccccactggtctaagaggtccctactttcttcttgggccctcctgacctgaaatactttgttgagtgttttccccccagtcatctggctgcatccgggttcttatggtgtccagacgttaatggtctatggggcctgtgttcgaatcccagctccacccctgctcctgcttacctgcagagtgattctgagtttctttcttttcttttttaaaattttataaatgtcaatttttgtagataggggtctcgctaacagggttgcccaggctggtctcgaactatggggttcaagtgatcctcccgcctcagcttcccaaagtgctgggattacaggcatgagccactttgcccaacccattttgaatttcttaaggactctgtgcctcagtttcctgatttgtaaaaccggtgatagtatcactcccttatagggtagttgccaggattgaacgagttaacatttgcagtgcccgacagattgtactagttactgattgaagggctgttttactatccaaatgtggctggagtaggagttgggtaaacatttattgaagaatgtgcaaccactctcacttggaagccgggctgttaggaaggggaggaggattccagtcgcccagccctccccccaccaaacgcaactgccccggcgcaaaagaggccgcggaggccaggcaggagcaggtcctggaggcctggtcggcgtgggcgttttattccgagaccaaggggatccactgcagagttctccgctgggcgtgacctcgggctgcagcgtgggaggaagcgcgcggcaagacacccagcgaggtgctggggtcgcccccaggagaggacggcggctcggactgtccggcggcggcggcggggacagcgacaggggcgcgaggtggccgggacccgggccgggcgcgccgggcggggcggcgcatgcaaatctgccgggcgccggggcggggagcaggaagccggggcgggctgggtctccgcgcccaggaaagccccgcgcggcgcgggccagggaagggccacccaggggtcccccacttcccgcttgggcgcccggacggcgaatggagcaggggcgcgcaggtaggatccggggcccgcgcgcggatcgggttgcgaaggtatcgcccgggcacgccggctgagggcgttcgggaagggctcggccgccggcggggaccacggggaccaccccgactccgagcggggcccgagcccgcgactctcggtgcgcgcggagcagcgcccggttccgtccttgccgccgaacggcagcggaggcgcgaggcccggggtacgtggacacccagcgctccccaaagccggtgctggcagtgagacctccgccgggacggcctgcgggggtggggggcttggggttaggctgtcggaggccacgcagcccctcttctccgggcagtggcgcccagccctgcgctcaggaagtcagtgaggacttcggagagagaaagggtggggaaagttctgagaactgtaaatttgagtagtaggtcagtgaatcggggcggtctccgcctccgaatatcagatggacccaataatcgcgatcattgactgggacttgttttactgaaaggatgccaagtgaaacctcccactaacttctctgtggccggtgctgtgcgtcatggacattgtacagatgaggtcaccaagaccccagccgctttagtaacttgccctaaggtgccgcccacttgggagtccgtggggcagcaggactagagcccaggcaatcccacgccagagccagctgctctccatctctcaatcacgtttgaggagcccccacaataaccagaatctccgggagatttgcttaaaatgcagattcccaggtccttgccctgagattcagattcagtaaacccaggaatctgatctttattttatttttaaaaatttattttataaagatggtgtctcactatgttgtccaggctggcctcaagtgatcctcccacctcggcctcccaaaatgctgggattacaggtgtgagccactgagccctgattttttttttaaacaaaatctggatttcttagacttaagcaagataggggaccactagtttgtctgcttctggggttcaaggaatgcccccaggccagcgctaaccctgctccagttctagtctctccccttccccagccctctgggaggcatgacccactgcacttccctgcccccagtagcctatgaggagcccaaggcatttgctgggacctcagtgcctttatcaaaatcccaaagtccaatggggaaacaggctcaggtgtaggtttggccagggtgtcctgcacattagggcattccagggtcctgcaggggtttcttagaactcggctagcccagcccatgaatgggaggtgacctgctaagccactcattcactcactagcactcattcagctcctgcgaggccctgggtggtgttctgggcactggtgcttgcctcaaggagcaccccctctgcaggaagacagacgtgagggctgggagggtgcggatgcaccagcggctgcaggaccacaagccagaggggatcagctcttcaaagggcactgggccaggcttcccagcacccagggaccctgagctagccttgtgagtagagcaggggagtctggcaggtagaggatgggaggtaaagggaggcacagagtgggcggaggctgggaagtgtgaaagggcactgtgtacagaacctagggagtaagcagaagccagagatggatggaaagttgggctgggctgcattgtggaaagccttgaatgccatgccaaggaacttgggccagtgtattcaccttggcttgagttgtaaaagcaacaatgcagattcctgggccccaccctgggcctctggatctgaatctggagggagacgctggggaggcagcagggaggaaaacctgcagtcactcaccccagttacaacacatgcagttaccggcaggtccgagataacctaagggtttccaaatgctaggaagtgactcaatgactgatatgtttaatacaatacaatcccggttgcaaaatgcccagggcaagggtgggggtgttcagttttctaatgctcccagttcaaaaaggagctgaaatgaattgtcaaagaagtgacaagctgggcgcagtgactcacacctgtaatcccagcactttgggaggctgagagaggatcgcttgaacccaggagtttgagaccagcctgggcaacatagtgagatcctgttcctacaaaaaaaatttaaaaacttagccaggcgtggtagcaggtgcctctagccccagctatttgggaggctgaggtgggaggatggcttgagcccaggtggtcaaggctgcagtgaactatgattgtgccactgcactgtagcctgggtgacagagcgagactctgtctcaaaataaacaaatacataaatacatgagaagagagaaccttttctacctcccccatctccctgccctcttccacccaccccatctgggacgatggaggagagcgtttgggattagatgccccacctctcgactgccctcactggtacctgggagtgaggccaggacagaagccgcctaagtactgttcttcctcacatttgtaaaagtgaactttcttgagggttgatgacatgttttataagctacttcacacaatgtccaacacccagtgggtccacaatcaatgtatatgtctgttgttacctgtcaaaacgtatagctggggagtgacagtatggacttgagccagatcacccagtgcaaatgctggctttgctgcttactgtgtaactgacttcccagagcctcagtttctgcatttatgagattatagtgactatgccattgtagtgatgactaaatgagttaatatatgtcaagcatacaaaacagtacctggtatgtagtacaaactatgtatttgttaaatgaataccttttttttttttttttagagccatggtctctctctatttcccaggctggagcacagtggcacaatcatagctcactgtagcatccaatacctgggttcaagtaatccttccacctcagcctcctgagtagctgggactacaggtgtgtgccaccacggctggctaattgtttttatatttttagagacaggatcttgctatgttgcctaggctagtcttgaactgctggtctcaagcagtcctcctgcctcagcctcctaaagtgttggatttatagatgcgagcaaacgtgcctggcctaaatgaataaatctttactgttgcctcctttgagctttattggttgggatttagtccactcattttgcaggtgagaactgagacccggagatgaatgcagtagccttgcctcaggtccacatctgagggacagactccatcctacttttcttcccatgtattctttcctgcttgtaccagttcactggggtgaccaagaaagacatttctgagttttcctcctggctggcacagtggagacatgcccagccacgtttagctagacttaccatggctgggctagaagagaggccaggagcttgtctggaggttgcacagacctgcccttggtgaatgtggatcggagcgccccggcagaggcttgaggtgctacagaggctgggggatccactgtcagaccgggtgcatcaccactgttttatgatatccagcaaattgctctgcgtctctgagcttaaggcagagagaagggcctgagcttgaagaggggatcccaggtttaaatcggagctggctacttcccagctctccactgtgtaatctggaggaagttgtttaacctctctgagcctccctttgttttgtcatgggtatttgcagggagagcattcatgagatagtttgtatagacattttgcccttggaaggcgctcagtgattgctgtttttctctgcattttggaccgagtcccttctgcgtatccagcacctggcttcctcctgcatttcttcctcaggaatttattgagcacctatatgtgccagagcatcggaccaagtcctttgctctcctggggtttagattctagttgagcatacaggcaatgtacaaccaatacatatgttcagatcggcagctttatctgttattctgaaatccacgatttctgaaaaccgaaagtttttcataactcattttgaagctaaacttgaggctttttagagtcttcatcctcttcggtgtgatgctcagatgtctttctgcagagatattagtgcaattgatctttgggtgctttcccgccctgcatgatgggcatgtcggtgggtattttatacaaggtgacctttctacagcctgagtcatcctgaattctgaactatgtctggcccccaggattttacaggagagaacatggacctgcaatatcctatcaggtggagactgtgctaggaaggaaagcaaagctgggtgcaagtggaatcagggagggcttccctgaggaggtgacatttgagagggaaatgaggaagagagggccaggtggagggactcacagaggacggaagactccacttcctgactggcctgtgcttacccctcattctgcatgcacagttctgtctaaatgcgtccgttcttgcctttccaagaagtgctgatgtctcttacgtttcaagtctagctctgactgactcattctctctttaggtgcccccacaggcctcctcacctcttctcgtttgcttaagaaatctgaggtctgcgctaaagccagcctgggtgctgtaacctctcggccgaggatggtgcccagctgggcttgcatctggagttggaggaagtgggtcccgggaggggaagaggagccgtggggccttccaagggtttggtggaattgagttcctggtggggaggggctgtgttctgggtcttagagcctctcgcctgcaaagcaaagttgaacgtaacacgcgctcacatatctcgagtgccagcccggggctaggtgcttaacgcttgcttagccaaagtgccaggggctggggacacgggaatgagtgacccagaaatgagggccctcatggagctgaaagcattctgggcttggtgactttgaggaagtggcttttgaactgagacctgaaataccaaggcatgtggatatctggggaaagagtgatcctggcagtgggaacagagagtgcaaaggcccagaggcatgaatgagcttggtgtgtttgacccacagcaaggaagctggtgtggttggatggaaccaaacaagaaagaggtctaggagcagaggtcagggagggagctggggccagatacctgcattgtctcatttaacttgtgtaataaccctaccagataggagctactctcatgcaaatgttacagatgaagtaacagaggcacagagaggttcagtgacttgtccagggtcacacacctgaaggtggcagagcagggctgtgaacctagaagctccagagtcctcagtcctcaccatggtgtttaaacacaataaaatctatgcctgagtgctgaagacacacctgccatttagatcgatccacttttttacattgtcggtgtactccctgccatccatctgcccagaaatactgtgaatgtgggcagcgcaggactggttcctccaagccccattttacagacagtccaatcattttacatattattttatgaatgagcaccttcctcagtgtctcagaccaggggtccccacacagcagggccacacagcaggaggtgagtggcaggtgagtgagcgaagttttatctgtatttacagctgctccccatcgctcgcattaccacccaagctcggccacctgtcaggtcagctgaggcattagatgattctcacaggagcacaaacccttttgtgaactgcacatgtgagggatctgggttgcgtactttttcttttttttttaagacggagtttcgctcttgtcgcccagactggagtgcaatggtgcgatcttggctcactgcaatctccacctccccatgttcaagtgattctcctgcctcagcctggtggctgggattacaggcctgtgctatcacacccagctaatttttgtatttttagtagagacagggtttcactgtgttggccaggctggtgtcgaactcctggcctcaggtgatccacctgcctcagtctcccaaagtgctgggattacaggcatgagccactgcacgcggccctgggtgcgtgcttcttatgagactctaatgcctgatgatctgtcactgtctcccatcgcccttggatgggaccatctaattgcaggaaaataagctcagggctcccactgattctgcattatggtgagttgtataattatttcattatatgttaccatataataataatagaaataaagtacgtaatacatgtaatgtgcttgaatcatcccgaagccatggccccaaccacggcctctggcagtggaggctggagtccacatcacgctctgtgctgggtgcaggaatggagatgagtgggtgtcctgctcatttccctgaggaggaacctgaggctcaggctagagacttacctgggtgacacggctcctaagtggcagagtccagattcaaacccagggctacagacccagaagcctgtgcatttaaccacggttctgagctatccagcccaaagaggagagtttaaaaggattacatttcttcgttggaaatcagtgagcatagtcgcccagaaccatttttgaaaaactcagagaaggcctatgttttcctgaagcggccagggaagtattctgcctttttaaaagggaagactgaattctagggaggagaggcaccagctctctgggctgggcaggtctccaagctggcagggccacagcctcccgacggtcttgcctctagcatatttcttccagaagccacatttccacaggtgggcagctctaactgggagaaaatcttcctgagatttagccaaattagctttctttctttctttttttttttttgagatggagtctcactctgctgcccaggctggagtgcagtggcgcaatctcggctcactgcaatctctgcctcccgggttcaagtgattctcctgcctcaacctcccgagtagctgggatttcaggcacacaccaccacgcctggctaatttttgtatttttattagcaatggggtttcaccatgctggccagactggtctcaaactcctgacctagggtgatccgcccacctcagcctcccaaagtgctggtattacaggtgtgagccaccgtgcccagcccaaattagctttctaggagcttccactttctgagtctgtttctgcctcttggaggtagtgaccatctccctccaaactcggatacttctcttattcagactacacaactgtagttatttcaggtattctccctgactcaggaaattataagtttggcctgccttggcacatgagtcaactggttggagtcccacgcaaagactgtttgtttggtcaaagaggaaggagactattacctccttggatctagagcttatacttctgttgatgcaacctggaatcatactgtgtagcagccatatcccacttggagtgcatattgggcttgtcagctaaaatctccatgtttctcttctatatgagctgctgttaatccaagtttcttctattctgagagtccttgtctaaagctaagaggttccagtttttcatgctctctaataaatctacttcaggctaacatgctatcattttttctttgagtactgctttggtttctttccacaacttgttacacaatgttattcactgcccagtttagaatttcccttttggttcccattttaagacttatttaattatatgctttttaaatttttgagacagatagaattttttaagttatctttttattgttgatttctaaatttggtcatcatggttgttgtggtcaatatatgtggttcctataatatcagtggtagagaatttgctgagatctttataggattttctggtcatttttttcctcttgtgtttgaaaagaatgtatattttctgttgggtataaggttctagaaatgtatctatttgatcaagctagctattatattatctatatttgttatgtcactatgtggttttttttttttttacctgatttacctcccaccgtaatacaattacaattcaccataatagaggctttgttaagttctccttttgagtctgtcagttttttgctttatttttgaagctatgttgttaagtgcatagccatatgagtagaataagggttcaggatttttatacctttttggtgaattgttgcattttcccgagtagctgggactacagatgtgcactaccacgcctagctgatgtttgtgttttttgtagagatgggatttcgctatgtttcccgggccagtctcaaactcctaggttcaagcagtctgcccacctcagcctcccaaagtgctgggattacaggcatgagccaccgcagctggctgaattgttcctttaatcagtataaaagagccaacttccagcctgggcagcatagtgagaccccatctctaccaaaaactaaaaattagctgggtgtggtggcgtgcacctgtagttccagctacttgggagggcgaggtgggagaatcacttgagaccaggaattcaaggccgcagtgagctatgattgctccactgcactccagtctaggtgacagagtgagacattctcaaaaaaacaaaaacaaaaaaaccatccaccttctctcttctaatacttactcaagacatcattgtcatgaattctattttattgatgtcagtactcctgtactaataagccagatgagttaaaaacaacagcagccttgcaaccagccatgaagcaagtgatcttattctcatttcacagatgaggagactgaggctctgagtggactccagcctgccacggtctcccaccgagtcaggttggagcctgcacttaggcccagagttatgcttctgtgtctcagatgcttgggggtccctgcccacaaaggtggcccccatgtctgtgtgtccccacccatccaggaatggtatggggtgagacaacaggaagagctccatgggtagtccccacccactgccttccatatgccagtctgcaagcagaaaatgaacgggaagctcttacctgtgcccatgtgttgtcctggctttgggtttgcccagggggcaaagtcctggtcattgttgagacaagttcactgctgctgagggccgagcaaatggtgacaaaggccagattctaaattcctacctggttacttcctgctccgtcaccatcacctcgggcaaattctgaacctccctcagcctcattcctccatctgtgcttgcagggagaatattttactgtatcttccatagtgagctttccaggagaagcaaaaaagagtggtgtataaaaaagcaagtttatgactgcttctgtgccaggcactgtgctgtgcactccagagccaaaggcctgggttcaaatcccagcccactcactagctgtgcatccttaggcaggttcctgaccctctctgggcctcggcttctccatctctgcaatggagatgatattaattgtatctgcaatgctccttggattgggtccatggttaagtgagtgagtgaggctcaagggcttctttttttttttttagagatagggtctcactctgttgcccaggctggagtgcagtggcatgatcacagttcactgcagctgcgacctcgtgggctcaagccatcctcctgcctcatctcccttagtagctgggactacaggcatgtgccaccatgcctggcaatttttttttgtatttttggtagagacggggtcttgccatgttacccaggctggtcttgaactcctggactcaagtgatctacctgcctcagcctcccaaatggctgtgattacaggtaggagccaccgcgcccagccttcaagtgcttttttttgttagtgagactggtacaaccaatgccaaggctggtgagcaaagttgcacccagttggggaggggcgaaaccaagggcagaagggcccagggcatggcctctcatggctgaaggaagaggggacacgtggccagtcacagtgacctctgcagacctcaagaaggaggccagctaggagccatagctgtcactaagacagtcaaaatctaatcagcaccctggcgccaagaggccattgtccgctgctcaggacagtgagtgatagtcgataaccagctctctggaggtcagggccccgaggtggctgagatctgtgcctgcattaggacatttaaggggactccaagccaggatttgctagtgtttgcccagcagggagaggtggaaaattggggatgaccaaccaggcctccctgctcacagccaggggaattcatcctgtcgttcttccattcagcaaatattcatggagcacctgctgtgtgccaggcaccgtgctaggctctggggagatggctgtgagcgggatcgacactggccttgtgtgagctggccttgcagtaggggatatgagcaccaaacacataaggcccgagtgtgcaatatgccacaaagattgcagagaaataaagcaagataacaggttgcagaaagatggaggccaggctggctgctgttcctgggtaggtggcttctggacacagtttcctcaggctctgtttcctcctttgggcctctggaatcttctgaagacaggcctggcttccaggatcccggatggagttgcctgttgactgtgtggactcaaagtgtccacagtgcgccggagcgcgtggtcttccccagcaaatctgcttctcttctcggctctccatcgtgggaagggtccctgggatcctccccaccaccccagcctgaggccactttccctctgtccccgctctccccagcctgctttccccaccaagcgccaccaagtccctgctgcctcctcctcccaaacaggctcaaacctgccccctcttcgccagctctcagctcagcccgctcctctcctgcttaagagccttcactggctccccactgccctagagacagagtttgagtctactgccatggcttggcagacgatgttgtccctggcctgccaaccttccagctgccatcccagccagtccttctcccccttgctccagccaagggccccgcttgtagggtgggaagtgggccgtgccctccctcctgcctgcctattcgctgggtcttccctcattccctccctcaccccgccctctcataagaaccttcagaatctgccagacgcagtggctcacgcctgtaatcccagcactttgggaggctgaggtgggtggatcacctgaggtcaggagtttgagaccagcttggccaacatggcaaaaccctgtgtctgctaaaaatacaaaaaaattagctgggcgttgttgtgggcacctgtagtcccagctactcgggagactgaggcaggagaactacttgaacctgggagacagaggttgcagtgaactgagatcccaccattgcactccagcctggactacacagtgagactctgtctcaaaaaaaaaaaaagaaccttcagaatcataaaatgggtttaataattatacttatctcatagggagggcttaaagcacctaggccagtgtctggcaccaaggaaacactgtatacctgttaaaataagaataaaataaaatacacatgctcacttattgagtgcctgctgtatgtcgggcccctccccgagagaactctggtgcatccccgataaagaaacctgaccctctaggatgagggagggtcttccctgagcgcctgctaacagcctcctctgctaatctgaagtcctgcagcttgcccagcaggctggcttgtcacacgggctacccccacaggccgccatcttggaaaaggccaatggctgtggaatcattcttgactcctattagccttcctgttctctctcccgccccacagcatccatcctgtcagcaaatcctgtgggctctgtcttcaacacagatctagaattcagccccttctcaacctccccatctccgcagcctggtgtgagccctggcacctctctctggggccagtgtggtagcctcctcactgctacccacttctacccgtgcccccaccacccaagcaagagaggtcttttttaaagtctcatcatgtcacttctttgctcaaaacgctctggcaacttcttccttgctcaaatatttgttaaaagaagaaaggaatgaatgaatgaatggcctgtttgcatctgtaatagccagcacataggcagtacttggaaaacacccacagcaagaataaatgaggagatggctggacacggcagctcatgcctgtagcatgttggaaggccgaggcaggaggtttgcttgaggccaggagtttgaggttgcagtgagctatgattgtgccatagcactccagcttgggccacagagagagatccccatctctacaaaaatttaaaaattattcgagcatggtggtgtgtgcctgtagtcacaactacttgggaggctaaggcaggaggatcacttgagcccaggagttcaaggctgcactgagccgtgacggtgcgactgcattctagccacagaatgagaccctgtctctaaagcaaaaaagagaaggagaataagtgaggtacttgagcaagtgggtgaggatggttgagccacagcaggcccacagggaggctggtgggtgctgttggtggagggggccgatttgtgttcctggtggctgcagagccagtctgttgcctcccctccctcccactggctgggctggggacggagccaaccaggcagatcccgggccattctggggccctggcctggcctgccttactatcccagtggggccaccgacgtggctgccatttctggaaaccccagttctaggtaggttactgtcccaggaagaagtgcatgcctagcttcctgccagcccagcccagctgtcccagaagccagaggaagctctgggctggtttcttataagtagcatgactaactgattgcgccacaggagctgaggtttcaggccagtttctgtcgtggagtttcaggggtcagcggctccaaagccccagcccccacccgaggcccctgctgtccctggattcctctccacatgccacctgtcacagaggtgcttgcatcctgtctgcagaaccagcccctcctccaagccaggtttcctgcccagagggaagaagagcagaaggcctgtaccgccccctgtgcgcccccagtcctccgccccctgcccccctgccacccgctgtgggttcgggaagagtcctgctgggtcgcttccaggctgctgctggcttctgacatttcaaggcttaatcacttaatctcccccgagttttttaaaaaaagtgagtcaagtgtgttctcctggtggcgggcgtgttttcccaggcccatgcttctgctcatttcctggctgcggccttcactgactttgctgcttcctaactctgtgaccttggccttgtcacttgctgtctctgggtctcaggccaatgggtctcaggccagtggggctccccggacaaagttccagggttttggggactgcatttcaagggtcagcaaccacagtccttaaacacgtggattttggagtgacaatgcctaggttatggttctgtgaccaccagcaagtgctctagcctttttgtgcctcagtcttctcatcagtaaaatgggaatgttaatggcacctacctcatagggtcgttgggagaaccaaattgattaatatattgtaagtacttagaacagggccaggcacaaaataagtactgcatatacagttaactatggacaaaagcttgggacctggttcatgtttaaaaatgattattgaggccaggtgcggtagctcatgcctgtaatcccagcactatgggaggctgaggcaggcggatcaggaggtcaagagatcgagaccatcctggccaacatggtgaaatcccgtttctactaaaaatacaaaaattagccaggtgtgatggcgtgctcctgtagtcccagctactcaggaggctgaggcaggagaatcacttgaacccacgcggaggttgcagtgagctgatatcgtgccactgcactccagactggtgacaaagctaggctccatctcaaaaaaaaaaaaaaaaaagattgttgaatttattattgctgaatttttttttttttgagacagaactttgctctattgcccgggctggagtgcaatggtgtgatctcaactcattgcagcctctgcctcttgggttcaagcgattctcctgcctcagcctctcagcctcccgagtagctgggaatacaggcacccaccatcatgcccggctaatttttgtatttttgtagagatggggtttcaccatgttggtgaactcctgacctcaggtgatccacctgcctcggcctcccaaagtgctgggattacaggcgtgagccactgtgcccagcctattattgctgacttttaaaccattcattcatttaatatatgtttattgtacacatgctatgcctgtgtcaggcactgtttcaggcactggggataaagcagtgagcacagcagacataaagctctgccctcatggggcttgtggtctctcagagggaggcaaacaatgcatttatagacaaatacataatttaaatttgaggttacctattatactcccaacttgaaaaactagcagtatattgaggtggctatttcacatctgatggaggaatatgtcttttgtgaaccatttatgttctttgcctatttttcttaaagggatgtttgtcttattgatttgtaagaactcttcatatattaaggccattaaccgttcataatgtagattgctacctttttctagtcttttgcttgctgatatagttgggatgtcatcctctctaaatctcttgttgaaatgtgatccccagtgttggaggtgggtcctggtgggagatgttgggtcatggggacgggtccctcatggtttggttctgtccttgccatagtgagtgagttctcacaagatctggttgtttagaagtgtgcggcacctccctcctctctcttgccctggctgtcaccatgtacgcctgctcccctcttgccttccccgtgaataaaagctccctgaggcctccccagaagccaagtagatacgggtgctatgcttcctgtacagcctgcagagccataagccaattaaacctcttttctttgtaaattactcagtctcagatatttctttatagcaatgcaaaaatggactaacacacttgagttctgtctttttcttatggcatattttaatctaggccagacacagtggctcatgcctgtaatcccagcactttggaggccaaggcgggtggatcacttgaggtcaggagtttaagaccagcctggccaacatggggaaaccctgtctctactaaaaacacaaaaaattagttgggtgtggtggcacacacctgtaattccagctactcgagaggctgagacacaagaatcgcttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgattagagatagtgataagtactgggacagacataaacagggtgctgtgataagaagtcacagggagggcccgcattagttgaggggggtcagagaaggcttctgaagtgtttctggtgcaaatgcttggaaaagggagagctgggagtgtatcccagggctgaggccaatggaggattgcagaagagggagaggggataggaggggaatgttagagggataagcaggggaattggctcttttcttcattttcttaaattaaactttttattttcagataattaaagatttacacacagctggaagaaatcatagagaagccgggcgtggtggctcatgcctataatcccagcacttttggaggctgaggcgggcagatcacttgagatcaggagttcgagaccagcctggtcagtatgatgaaaccccatctctactaaaaatacaaaaattagttgggcatggtggcttgcctgtagtcccagctactggggaggctgaggcaggagaatcacttgagcctaggaggtagaggttgcagtgagccgagatcacaccactgcactccagcctgggcaacagagtgagactccatctcaaaaaaaaaaaaaagaaaagaaaaagaaaaagaaatcacagagagacccctgcttctatgctgttccccccgagggcaagattgtagaaatctgtaatacagtatcacagctgggatactgacactgatataagctactgaccttattgggatttcccgatttacttgtactcatttttgtgtttgcgtacgcatgtgtggtttagtgctatgcaattttatcacggcataggtttgtgtatgcagccaggatccagcacagttctatcatcacaaggatggctcaaattctccttttatagccacatccaactcccttcctgacccaccccctcagcccctggcacccactgatgtgttttccatttccatggttatgtgatttcaagtatgttacataaatggagtcacggggtgtgtactctgggaactggcttttttcactctagggcttggattttattctaagtcagagatgcttctctaatgagctgtgaaccccctggggatctgtggcccctgtgaagaagccctttaggagccagggggcattggatgtgtgagctggccctggtctcatttctgattttaaaatggctctggctgtgatgtggagaagaggcagggtgagcctcatctgcagcaactgctaactgcccacatccccccagacttctcaaaaatttgccactcccctgctcaaagaccctcaaaagctgcccactgcttagaggacaggcctttgacctgaggtcctcacttgggcttcagggattctgtgaacccctaaaatggaatgcagaattaagtgtatgcaccttgccagaaacagggtttggggtttacattagatgctcagataggtcattgatccccaaaacactaaggtctctgacttctagacagatagtagttaagaaccaaagctttggagcttgagtgctggatttaagacccatgactgtcacagctgtgcaacctcagacaaatcactcagcctttctgtgccttggtttcctcatctgaaaatggagaaaataatattacctatttcatagattattaaatgcattcttgtatgtaaaagatgtaaaagaaaacttggcatgtggtaaactctgtgtgtttaagtgaatggtgaggctgcccagtataggagggcagagctttccaggtaaagactttctaggcctcctgggattatcaggccctctctgtgttggttgttgtcatacatgacagcagtattccttccaaagggatgccaagttgtggttgcacactgcacttagatccagttgattgacagcactgttcaagtcaactgtgtccttactgatttctgcctgctggatctgtcgattaccaaaagagttgaagtaatagtaataatactattattatccaataatagtattattcagaataatcacacagatttctctatttctccttgctgctctcagtttttgccttacatattttgaccctttgttgttagttgcctacacattaaggattgttatttacatcttcttggagaattaactcccgaatcattatatagtgccacttttttttaatttaaaaattttattttttattttttgagacaggatctttctctgttgcccaggctggagttcagtggcatgaacacagcccactgcagccttaacctcctgggctcaagtgatcctcctgcctcagccttcccagtagctggggctacaggcatgtgccacctctaataacttttctttaatttacaatagtattagtttgttctcatgctgctctaaggacatgcccaagactgggtaatttataaaggaaagaggtttgactcacagttctgcagggctggggaggcttcaggaaacatattatcatggcggaaagggaagcaaagacatcctttttcacatgacgtcaggaaggagacacgccaaggaaagggggggaaagccctttataaaaccatcagatctcaggagaactcactcactgtcacgaaaacagcatgggggaactgctcccgtaatctaatcacctcccatgaggtccttcccccaacacgtggggattacaattcatattacaattcaaggtgagatttgggtggggacacagagccaggccatatcacattattattaattagtgccttctctctcatttttttgattcgcctaggtagagatttatcaatttcattgatcttttcgaagaaccaatttttgatttcattgattttcctcgattaattttctatttttaatttcattgatgtatgctccaattttgtatttttttcttctgcttgttttagacatatattgcttttctgtttctagtactctagatggaaacagattattgattttagaactttctttctaagatatacattcaataatataaatttccctctaagcactgcttttgctacgtctcaccgattttgataggctatattttcatttttatttagttaaaaatatttttagtttctcttgtgatttcttctttgatccatatgttattcggaagtgtgtttttaaatctccaaatacttggaaattttctggctttcttcctgctagtgacttctaatttgaatccattgtggcctaagagcatatgttgtgtgatttctaatgttttcaatctcttaaggttgttttatgtcccagaatgtggtctgtcttggtgattattccacatgaacctgaggagaatgtatattctgctgttgtgagatgtaacagtctataaatggatacctctgttaatatgacctcgggtgactctttttttttttttaagttgctgcttcaccattggcttttggagattttgcagatgataaaatcctcaggacttttctgctgctcagtcagattttcttatcctacacttgcggaactgttgtttgaaattgacaagcaggatggccaactctgcccggctcattttatttcatcttattgggttcagcctgcagttttaggagatgagattgaaggaactggtatactggaatccacggtgggctcggaagcaaacaaacgtgggttctgattctagctctgaccttttaccagctgtgggacctggtggatgggttatttggcctctctggcctcagtttccttagctagacagttgggataacagcctacctttcaggattcttgtgtggattcggtgaggtaatacttctaaagcacctagcaaagtgtcaagtacaaggtaagtgctgggcaagcagggattttgttcacacaaagccttgactcaacataaggaggctgtttccaatggctctgcttaactgagacctgagagtgattgctccatctgtggtggcatatgggctgaaactgcctagcagcatgtcagaagtggggtgttcgcaggacatccttgtccaggttggcagttgagcttggcaggtgaccgctgagaccccttccaactccaccacttcaggaatctcttttttttttttctgagacagtcttgctctgtcacccaggctggagtgcagtggctcaatcttggctcactgcaagctccgcctcccgggttcaagccattctcctgcctcagcctcctgagtagctgggactacaggcacccgccaccacgcccagctaattttttgtatttttagtagagactgagtttcaccatgttagccaggatggtctcgatctcctgacctcatgatctgcctgcctcagcctcccgaagtgctgggattacaggcgtgagccaccgcgcccagccaggagtctcttgatttagaatgggaacttgaaatcatctcctcttgccgtgtacttgaacgcgataacctggcacttatctttttaattcttttactcacctgcatctttgttctttttgcctctgatgttcagggaagcctcttctcccactgcatctgtgatctctcctgaaatgtagcacccacacatccctgagaagctagctgcggcacgtgtgtgtgcacatgggcatgcgtaagtctgggcgtgccttccacaacagattaaggatatcaatcctgacgccatgctgggatgttttagtgaatcttgacagggttgttgactcccctgtttccctggaggactttaccatgaaagtcttctgctgtgtgactttggacaggcgtcttggcctctctgtttctctttattcataattgaggctaaagtgacacctttgccatctctgccacaggatactgtgggcatctgtgtagttgtgagagtaaaagttactaggacttgccaaggaaatcagtgtcaggaacccaccaccccattcccgcccctcctttacttgagactttacttttgtaactctcagcaaggaagacgagttcaacctttgagccgatacagagccttcccctagagagagctttgcagcctcatgctgagccagttaggggccccacatcatgtccaaaatgaatttaatcaacaaacagttactgaacacgtcctatgtgccaggcaccgttgtagatactggggactcggcagtgaatgggacagaccctggctgtcaggatgacagacaatttaaaaagggacagatgtcccacgctggcttgtcctttgcacccccggcacttcgtgaggagcagcggccagttcttgtatatagactggcccttggtgtacatttgtctgacgtttccaaatgatgtatgcatccttggcaggaacccaggaaaagacatgctgtgctcttctcaggaattgtttcagggaggtgatgttggggatttgtcccattcttgttggtgagtttagatcacttggtgaaggtggtgtctgccaggtttctgtattgtaacgttcattgatatgtattttcactcattagttaatatacaatacaagttttgcagggagttactttgaggctgtcatagtaaaatagagctttcccttcttccctgtttatttatttattagagatgaagtctgactctgttgcccaggctggagtgcggtggtgcgatcatagctcactgcagcctccaactcccaggctcaagccatcctcctgcctcagcctcccaagaagttgggattacaggcacacaccacactgcacccggcctcctccatttattgatctatgtcaatacagactcctggactttaactccaagggttacaagtggataccataatattcattttgatgctcaaaatgtgcctgttttgtccaggtcaggctagctgctgagtacttccttattgtctggcacaagaattccaagcctatctggtacttttccttctcctggaatcagctatttctctaaggcgctctggttcctttcagtacagaatagtatttagaagccaagacctggtcactaggaaggcatgataatcaaatgtgatgaatgatcttggattgcatcctggacgtataaagggcattattgaggcaattagcaaaacataaataggggccgtggatgagatagtggtgatgcatcactgttaatttcctgatttcgatggttgtattgtgattatgcagagaatgtccttgtttttctgacatgcacactgaggtattggggtaatttattcattatggagatatgtgagtgtgtttatgtgtctcatacacagatgtttcttaatgatggggttttgtccccataaactcatcataagttgaaaatattattaagtcagaaatgtacttcatactcctaacctactgaacgttatagcttaacttagctcggaacacttgcattagcctacagttgggcaaagtcatctaacacaaagcctgttttgttataaagtgttgaatagcttgtgtagtttatggaatactgagagtgaaaaacagaatggtcgtatgggtgctccaagtactgcttctactgaacacccattgattttgcaccatcataaattaggggaagagaggaaaagcacgcgtaagggaggaagggccgggtacagtggctcacgcctgtaatcccagcactttgggagaccaaggtgggcagatcgcttgaactcaggagttcgagaccagcctgggcaacataatgagaccccatctctatcaaaaatacaaacacttagccaggcctcatggtgcacatctgtggtcccagctactcaggaggctgaggtgggaagattgcttgagcccgggaggtggaggttgcagggagtcgaggttgtgccactacactctagcttgggtaacagagtaaactctgtctcaaaaaaaaaaaaaaaaaaaaggaaagggaggaagggaaggtccctccaggtggaggggacagagagagaaaaggcatggaggtgggactgagtttggtgtgtttaagaagtgcaggtggcagccgggctcagtggctcacgcctgtaatcccagcactttgggaggctgaggcaggcggatcacctggggtcgggagttcaagaccagcctgaccagcatggagaaaccctgtctctactaaaaatacaaaattagttgggtgtgtggcccatgcctgtaatcccagctactcagaaggctgaggcaggagaatcgcttgaacctgggaggcggaggttgcagtgagccgagatcgcgccattgcactccagcctgggcaacaagagtgaaactctgtctcaaaaaaataaaatgaaataaaataaaataaaatgttaaaaaacaaaaaagaagaagtgtaggtggcaggcgtaggatgcatgggtgctgggcccaggtggagagggaggtggagccctgctggggggagggccttcaagtgtgcccaagtcactcggagagcatccagcaggggcctagagctcctgaggtggccttaagttcttatgatgccccagacactgcacacagtgcttcagaggcaacacctccgttcctgtttgctgcaagcctgtgaggttagccttggaaccattcctgtgccacagaaacacagccagagcaccaaaagagaaatgctgttaatggcaaagaactactcactagcagaacaaagcctgggagctgcttttttgaataagatcccaggagagagacccaagcgggaagtgaaggatgggcacttgaaatgttgcagggaatataacccagcgcgtgctgttttctttttttctttttcttttttttttttttctctttttgcaacagggtctcactgtgtcgcccagcctagagtgcagtggtgccatctcggctcaccacaacctccacctcctaggctcaagcgattttcctgcctcagcctcctgagtagctgggactacaggcacgcgccactaccgcccggctaatttttttttgtatttttggtagagacaggtttcaccatgttggccaggctggttgtgaactcctaaagtgctgggattacagatgtgagccaccacgcccggccccagtacacactttttggagggtatttgacgttatgtaccaggagtgctggggaaaagtacacacttgactccgtgagattctgcttcttagcatttttttcttttcctttttttttttttttgagacagagtctcactctgtcacccaggctggagtgcaatggcatggtctcggctcgctgcaacctccgcctcctgggttcaagcaattctcccacctcggcctcccgtgtagctgggactacaggtgtgcgccaccacactcggctaatttttgtatttttagtagagacagggtttcactatgttggccaggctggtctcaaactcctgacctcgtgatccgcccacctcagcctcccaaactttctgttttcttttcttttcttttttttttatgacagggtcttgctggagtgcagtggtacggtcttggcttactgcagccttgacatcccaggctcaaacgatcttcccacctcaacctcccaagtagctaggattacaggcatgcaccaccgtgcctggctgattttgtttaatttttgtagagataaggtctcactctgttgcccaggctggtcttgaactcctgggctcaagccatcctccctccttagcctcccaaagtgctgggattacaggtgtgagccaccacacctggcttctgaacattttttcttaatgataatagctggtgctatgggctgaatgtgttcccccaaattcatatgttgaaacttcatcccattgtagtcatattaagagatggggcctttggagaagtgattaagtcatgagggctctgtggttggtcatgaatggggttagtgcccttatgaacgggctgaaggaagtgtgtttgccccttctgtcatatgaagacacagcagcatggcatcgtccgtgaggaatgggctctcaccagatctggatctcctagtgtcgtgatcttggacttcccagtctccagaactatgcattagaaaatttatttatttattatttatttattttgagatggagtcttgctcttgtcgcccaggctggagtacaatgacgcgatctcgactcactgcaacctctgcctaccccagttcaagcgattctcctgcctcagcctccagagtagctggaattacaggtgcccgccaccacactcggctagtttttgtatttttagtacagacggggtttctccatgttggccaggctgatctcgaactcctgacctcaggtgatccacccaccttggctccccaaagtgctggaaatacaggtgtgagctactgtgtctggcctgaataataaaatttaaaacaatttttcaaaaattcaccatgaggtctcactatattccctaggctggtctcaaacccctggactccaagtgatccaccccaccttcccgagtagctgggactagagatgcacaccattgcacccaatagagcaatacgtttctgttctttgtaaattacctgctctaaggtatttttgttatagcagcctatatggactaagctgacttgtaacgttacttgagactttaaagtgttccggtcactgttggagggctctgtctgtgttagctcatttaatccccacaacacctcaatcagatggggctattcttagtcccactttatagataaggaaactgaggcatggaagcacagcttgctcaaggttcacatctagtcagtgacagagcaggtatttaaacctcaggaaataatcagagaaacatgtgtagagggttgtccaaggaaggccacatccagaagcatctcccaggacagttgttgtgtagctcaccctctggactttgtgggtctgggtgttgtttcatgattatagagagagctctgtgaacgtggaggacctgttgtcggcagagacacaaatggccagggcatggctgggcagccgcagtggctcaggcctgtaatcccagcacttcgagaagaccagaggggcagatcatgaggtcagaagttcaagaccagcctggccaacatggtgaaaccccgtctctactaaaaatacaaaaattagccaggtgtggtggtgggcacctgtaatcccagctactcgggaggctgaggcagaagaatcgcttgaacccgggaggtggaggttgcagtgagctgagattgcaccgctgcactccagccttggagacagagcgagactctgtctcggaaaaacaaacaaacaagcaaacaaacaaacaaataaatggccagggcaggggagggttgcatattgaataagatgagctctgctggaagcacaggtcagcactaacctgcttcctctctctctgcaggtgccttggcatctcccaatggggtggctttgctctgggctcctgttccctgtgagctgcctggtcctgctgcaggtggcaagctctggtaagtcaccacttctcaatcattcatttgttggctattaatggcgtgccagggtcctgcagtatgtcacctggccttatggagattacactgcagtgggaggggacagccaatgacaagtggccctgattatcagtaaattctaaagattgttagaaagtgatgggagccgggtgcagtggctcacacctgtaatcccagcacttcaggaggccgaggcaggaggatcgcttgagcccaggagttcgaggtcagcttgggcaacatagggagaccttgtctctacaaataataaaatattagccaggtgtggcagtgcacgcctgtagccccagctactcaggaggccgaggtgggaggatcccttgaactcaggaggtcaaggctgcagtgaactgtgatcgcgccactccactccagcctgcgtgagaaagtgagaccctgtcaaaaaaaaagagaaggtgatggggaaagaacacagaacagcataagagggggttggggaagctgggtggagtgggggggattgcagttgaaagtagggaagtcagggaaggcctcattgagctgacttggaggaagcgggaaccgtgcagatgtctggggaaggctcattcttggcagagaggccctgcactgagcctggcgggagggttgagcacaggagggaatgtggtggaggagagtgagcagcaggagggagcagtgaaggtcagcaaggtgacagagtggctgaatcaaaaaagaccttgcagtgtttgagcagaggatccatatcatccattatgttccaaaggactcttcaggatgccgtgtggagaaaggaagagggtggaagccaggaggtctggagggaggtctggagtggaggagatgagaggctccggatccctctgggaggtagatttgaggacagattggaattgaggtgaaagacagagaaagagaagtggccaggatgactccaagatttctgacctaaactactgggaaggacgcggttgtcatttctgaaatgcagaaggatgccagaagagaaggtactttggggaggggcgggaatcaggagttagttttggacatgagataagcttggaatatttatttgctatctaagacagctccttaacatggtaagcccttatgcaagttgttgtcagctgagatgggcgtggcactgagcatgggagcatggaggcgcctgagtggtctcatgctcaggtggtttagcaaactcagtgtacatcctgccaattccagtcctgccatggccactgacaagctaggagggcgctgaaaggagaaggaccccgatgtctcctccagcccatccatctcctctctcccattggccaaacccaaccggaaactaaaggccaagggtacccggtgatgaagactgtggtatcagcctcctgagcacagagagggcagaaaggggtggagacaaagaggggcgcagatagtgggcaaatggggaagtggcacttcccctagctcgagggcagaggcttggtgtgatggaatggcactccttaaactgctacatattttccctttaatttggccaagaacaagttgtcaagtttgtgtgagataaaggtgcacttggttcgttcttgtctaatggcccccgcacccatgggtatttcttcagcttccacagtcatcccgacactagctgggaagctccagcagccctggtcctggccccagctctgtgggcgctggccctcaactttgcctgcactgtgcttttgtgctattccccttggtcctgtttgggtgcaagtccccctcacgcattgagttcctgggccgctcaggctgctcctgtgtctccccagggaacatgaaggtcttgcaggagcccacctgcgtctccgactacatgagcatctctacttgcgagtggaagatgaatggtcccaccaattgcagcaccgagctccgcctgttgtaccagctggtttttctgctctccgagtaagcctgcgctggagctggaggtttggggaggttgtgcccaaagggtttgccccaagagtgagctgggtccaggtggtgcgctggagtgcaggatgctgagtatggtttgctgctgtttatatggtgttagaggggaggtcccatctccagggacatgttatgtaagatacagtggagcgcatggtgggagtgttggtccacgtggcacatggatacggctggaatactggactagaccagcagttctcacactttttggtctcaggaccctttttcacacttaaaaatgagtgaggacccaaagggctttggtgtaggtaacacatcattctatgtttacctaattagaacttgcaatgaagaaatggtgtaatttttaaaaaattaaaacaattaaaaattttttttcttactgaaatggaggtctcactgtgttgcccaggctgctctcaaactcctgggctccagtgatcctcctgcctccgcctcccaaagtgctgggattacaagcgtgagccgctgtatccggcccaaaatggagaaattttaagtcccaacaacatgcaagcccgcattcaacaaatcttcagatcaattacatgatcacaggtcatgtagcctctagaaaattccactgtacgccagtgagagagagtgaaaaggcaaataacgtccctgtattatgatgaaaagagttttacctggtgggcccagaccacactttgagaaccactggactagacccttgattgaggagtacggtgttgagagtggagtcctctgtgatggtggatggaccaggacacatggcataggagtcaggtggttccctgggctactccatggtgcacaggatgcttcgttacactggtgcccaggacataatcacgtacacaagacacacagttacggggcagactggggatatacggcacaccagcatgcagggttcaccagtaaaggtggtattccatgattattctaaggtagatgggctgtgctttgtttccattggcttagtccagggattggcaaactatggcccgtgagccaaatccggcccactgcttgtttttgtaaataaagttttattggaacacactggctgctgtagttgtaacagaaactgcatggccctcctttatgttttttgtttgtttgtttgtttgtttgttttctttgagacagagtttcgctcttgttgcccaggctggagtgcagtggcacaatctcggctcactgcaacctctgcctcccgggttcaagcgattctcctgtctcagcctcccgagtagttgggattaatggtgcctgccaccacacccggctaatttttcgtatttttagtagagaccggttttcatcatgttggccaagctggtctcgaactcctgaactcaggtgatccacccgcctcagcgtcccaaagtgctgggattacaggcatgagccactgagcccggcctcctcctttatcttaattgaaataattcagaaatggaaagtcaaatactgcatgttctcacttataagtaagagttaaataatgtgtacacatgggcattattccatgtaccatggaataacagacattgaagacttgggagggtgggagaggggtgaaggaagagaagttacttaatgggcatagtgtacaccatttgggtgacggacccaccagaaccccagacttcaccactaggcagcatatccagtgagaacagatctgaggcttgccatcaaaattgcacttgtaaggccgggcactgtggtggctcgcggctgtaatcccagccctttgggaggccgaggtgggcagatcacttgaggtcaggagttcgagaccggcctggccaacatggtgaagctccatctctactaaaaatacaacaattaactgggtgtagtggcgcacacctgtaatcccagctactagggaggctgaggcgggagaattgcttgagcccaggaggtggaggttgcagtgagccgagatcacatcactgtactctagcctgggtgacagtgagactttgtctcaggaaaaaaaaacaaaaacaaaaaacaaaaaactcgtaccccctaaatttatacaaataaccaaaaaaaaaaaaaaaaaaggaaattgtgtggcctttgaagtccaaaatattaactatctggcctgttacagaaaaagtttgcagacccctggcctagcccgtgagatgtgggttggctgttaaggtggaacattggaattatcttacgatggccaaactgtgcgatgcagagcttatgttgttctaaattaattagtgccaccggttcttccctttcatgggctttcaggaacaagctaagtcccaggaccagggccggcagctaggcaggtgtgaggagcatccttggtgcatgtggtaagaggctgtggccagcaagagaggcaaccctagtcggctgccccagcacaccctggccgctcccaagcccccagatctgtcctcacatccgtgatcgggaagctggaagagtctgatgcggttcctggaggcatgtcccggacacagctgtggggcccagccagcctacaggtgaccagcctaacccagcccctgtgtctgcagagcccacacgtgtgtccctgagaacaacggaggcgcggggtgcgtgtgccacctgctcatggatgacgtggtcagtgcggataactatacactggacctgtgggctgggcagcagctgctgtggaagggctccttcaagcccagcgagcatggtgagcagggcggagtgcggcaggggtggctgggtgtgttcccacagctgcctgggctgagggtggggtgggcaggggaggaggtggggtcatagcaacagcaggaggaagccgcctgtattttcccaaatctgatgggattcctgcccctgcctgggcctcagtcctcccacctttgaaacggagctggtcgcagtagaccaccaagcccccttcagcccagctgtttccacccctgaacttaagtgcccaggaaggcgtattgagatgaggtgtgcttgctggaaggcatgcctgctgctgattgaaaaccgaactgggaacattccttccattctgtgtccactggtcagctgctgcggctttggatggtcttgaccgtggaaggctgaccttcttctggtacccggagtccctgcaggaatcccccttgagcttgctgggctgtggtgacaggagtttaaaacatgcgttgtattccagtgatgcatgatatgacatgcatcacaggaataaaaacctgaggtctcatggatatgattgcttcaaaggagaccaagttttaaaacagatgaatcaaaataaagaaaaatactcagtaaatcatcataaagtacagagatgtggccaaaggtgtgaaggatgcagctgtaaaagctgaagtttgaggccgggtgtggtggttcatgcctataatcccagcactttgggaggccgagcccagcggatcaccggaggtcaggagttcgagaccagcctggacaacatggtaaaaccccgtctctactaaaaatacaaaaaattagtctggcatggtggcaggcgcctgtaatcccagctacttgggaggctgaggtaggagaatggcttgaacccaggagaaggaggttgcagtgagcttagatcatgctactgccctccagcctgggcgacagagtgagattacgtctcaaaaaaataaaaataaataaaaataaaaagattttttaaaaggctgaagtttgggttactttggctcatacactttgccttcactgtagaaaggtggttagtaaagaccaggcgcggtggctcatgcctggaatcccagcactttgggagcccagcgcaggcagatcacttgagccctgggctattgaggctgcagtgagctgggattgtgccactgcactccagcctgggcaacagagtgggaccctgtctcaaaaaagaagaaaaaaagggtaattaataaacactaaagttctatgtagaattttagcaacattattgttattataatcttctttgctatggctctgaatctgtgtggtgctccagaagtatgctatggaggttttgtcgaccaaaaatctgggtggtggctgtggtttgtaggccggggctgggctgggtgatgggggagtcactgcatagatcctcacatagaggccgcttctcccgcagtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatgtgagtgggcatgctttgacgtttttctgtgacctctggggaacagggtgggtgaccagcagaggcccagtccctggagccaggagcctgggaggcaagccctggggctggatagcaaatcccaggagctagagacctggcttctcacctggctctgccctaggcaagtccctttgcttcctggccccccacccctcacatcagagaaggggagttatctctgcatgccgctcctcctctgtaaaggtagggctgtgggccacatctgtgtttcccagtttgggggacacaagtgatcgtaggtggcacattgacagctcacttgaataaccctattattgaagagaataatactgactcaagagacagtgacccgtgtcagttcccttttgaggccaacgggttaaggaggaagtccccatacagctgactcgtttactaattcctcttaatgaagagagcagaggccacaccccaggcttagactttcccaagaaaacaagatcagtttgttggttgttccccatggaagctggtcctgacattcccttcacagtagtgttggtggagtttttgttgttgtttgttttgagacagagtctcactctgtcacccagggtggaacacagtggcgtgatcttggctcactgcaacctccgcctcctgggttctagcgattctcctgcctcagcctcctgagcagccgggactacaggcacctgccaccgtgcccagctaatttttgtatatttagtagagatggggtttcactgcgttggccaggctggtctcaaactcctgacctcagatgatccactcgcctcggcctcccaaagtgctgggattacaggtgtgagccaccgcacctggccagtggagttccttcttaagtacatgtattgacatctttaaaaagggcgagaggatttacaggaaactatcaggtcagtaatggcaggggccgtccacagtgggtggctgagtccccctatttttctgctggtgtgcggggaggtcatttcctgccacccatgtttccccaccctgaatccaccttcctcacattcccattggagggacactctctggacatatgggacctggggtcccacagggctgcattccaatgcctgctgtgccactcgccagctgtgtgatgttgggcatatcccataacctctttgtgcctcagtttcctcatctgtaacacaggagtgacaagagcacccgcccacagggctatgacagtacaaggtgtgtgatacagatgagctcccctgtttggcccacatgtgtcctaaaagccatgtgccctttctcttgagtgccccaggccacagagatccccatctgcccgctgtcccacacactggtctgtcatttgttccttgaggtttgtgagggccggctctgtgcatcccaggggcccaggctgggcctggttggctctcagggagcaggcacccgccaccttaagctcccatgctggtgtctgtcactgcttcctctcaatctggccaagccaggggtgtcgatttatatctctcaggtctggtttcccctttggcactgggccaggtatggggaaagagcaggaatggggcagttggctcacacagcagaggctcagaaagcggggggcatggggggaaggagtgcacagatgctagagagtggggcaagttttgtttggtcaataaatctccttctcatgccccaggcctgtgcaagacctacagagagtcccaaggatgggctggggggaagagaaaggtaccaccttcagagtccaaagatatgttatttaatattttcatatttctagatctgccttcaggcatggctggatccagcttctaggaacctgtccagctctgcgccctgctttattctgtactggcttcgtttttaggcaggctcttccctcatgtagtggcagatatgcctactagttgctccaggcctacatcccaaagccacagtgggaaaagggttttttttcttgacggttctaataagagtcctaaggctgctgctcagtggcctggcttcgatgctgtgccagcctctgaaccaatcactggctgtgggtggagagagggtgctggtggagggccctgcttgtccagggaggagtcacatacctgcctctagggctgcaggtgggctcagctccatccaaaccagatgaactgaaaataaggcaggagtggcttccccaggggaaactggggaagaggaagcaggactgtgctggctaaaatgccagccaggtttaagacgtggcaccagatgccagtcatgggattggattggtcagcatgcctgggctatggcttaggggtatgttggtgctcagggatgccacaggcctccagataccaggtctgaggcagaagaatgaagtccagcttctcttgtgggtggaacagtggcaactgagataccccatctctcccttcccaagaacagagctgaacataaagaatttagtgattggccagagcttggccacatgctcccctctgatgaatgataggccaggtgatgggattggcacaattggcttagactaatgagggttggccctggagttgcaggcagtggagttctgtcctaagcagtgggcacctaaacccgatggcataaaagctgggcgggtgtccacctgcatctgccacagcactataggcaccaactgtggctcatactgagtgggataaattccagaaagaaacattaggaacttactatagaattttggggctagagctactcattcattcccctagataatttctaggcaaggttccatagtggagggggagttttggcttgggcattgaaggatgcataggagttttctagatggggaaagaagggaacggtagaccaggcagagggaactgcatgataaaaggtttatgggtgtgaaaattcatggaatgtttgaggattatggggttgggggatgtgggaatatgtgtagcgataaagcaccaaacaaagccaaaagtttagttagagccctgaatgcctgcctcataatggtttccatattttatatgcctactatgtgccaggcacattgctcagggtcacacagctggaaatggcagggctgagtttttgttgttgttgttgttgttgagacagagtctcactctatcacccaggctggaatgcaggggcgtgatcatggctcactgcatccttgacttcctgggctcaggtgattctcccacctctgcctcccaggtagctgggactacaggcacaggccaccacgccaggctaattttttgtatttttagtagcgacagggtctcgccatgttgtccgggctggtctggatctcctggcttcaagtgatccccctggctcagcctcccaaggtgctgggattacaggcttgagccaccgcatccagcccagatctgagatttgcacccagtatttgaactcccaagcctgtgctctttttcctcccatggacatttctctcagagatggtctcccaaacacctgtccttcttgttaaaaaacagacaaaccgcaagtagttctttggaagctcagatttctcttttgtttcttagtaaaacatttcccagttcccagctcccttccagggtgtaagatttcttcggtaacttacatctagctgttgcttcttgtttgctcatgtttagaaagaaagacaaaagagagtgagaattttctctcccttccccagtctccccacaactcacaccccaccctcagctccctctgtaataggaaaatctctgaactctctgtagttgctccagcaatcttttggaactttgcttctttcttgtgaaaaaacctccccttggctcactttgcaccaggtttccccaaatgtgcttccaaccacaagcagaaatggagctgccagtaaccaggaagaaactgccgggggctgaggaagaggagagggaggtgcatagccctggatctcgcagggagaggggtgacaggatgagaactcaggttgctcacttgccatcagggtcagtcatgaatatagcgttcatgtatcactttttaaagcttttttggagggtaaaagtaatagttacacaaaataaaaatacaaatggtacaaaaggacttagaatggaaacatgtttctctcccgactccagcctcctgtttttcttcccagagactgaccactgctgtctgtctcttgccagaagggaaagggaggcaaggttagggcaggcagagggcatgtgcatcctttagagagagcttatgtctatacaagcaaatgtgtgtgttcagtcatcgctgtcttagttttctattgctgcataataatggtactaccagcttcacagctttaaacaacacccatttattatctcatagtttctgtggttgggagtctggacatagcttagccaggttctctgctttagagtctcgtgaggctataatcaaggtgtgggatggggctgcagtttcatctgaggctcaattggggaagggtcacttctaagctcatacaatattggtgacattcagtccctggcaggctgttgaactgagagcctcagtttcgtgctggctgttggttgtagttaaccctgaattccttcccatgtgccctttgcaaagccatcaaggcagagagacttgcctagcaagtaggatattacagtcttctgtaatataatcacatccatgaaatcctctatatatcccatcacctttaccatattctgtgggttagaaacaagtagcaggtcctgcccacactcgagaagaccagatgacacaaagatgtgattcaaagtggggatcatcggggccatcttaggtttgtctgcagtgatcactgtgccatctctctctctctcttttttttttttttttttcgagacgaagtcgtcactctgtcacccaggctggagtgcagtggcatgatctcagcttaccacaatctctgcctcccaggttcaaatgattcttctgcctcagcctcctgagtagctgggattacaggtgcccgccaccacacccagctaatttttgtatttttagtagagacagagtttcaccatgttggccaggctggtcttgaactcctcacctcaagtgatccacccacttcggcctcccaaagtgctgggattacaggcatgagccaccatgcccagccccatctctctttaaaaaacaaacaaacaaacaaaaaacataaaaagaagcagagaacacatacacatctgcatcttcccttgtttacttaacaatagatcttggaagtcacttctcagtagaggctaggttgggcagagcattggattctaggccagtgagtttggacttgaccatggagacactaggaagcccatgaaggacagagagagatgcctcgaccctgccagtcctttagaaagatcacccagtgctttttgtataccaaaccctatttgaaatacttacgtatattaacccatttccttatcaccacaaccctgcgggaagggagataggcacttttattatcttcattttgcagatgaggacattgaggtccagagaggttatgtcacttacttaaggtcacacagccaggaagtggtagtagggactcttacccttgttttacagatgagattgaattatctcacgaaaactcagaaaggttaaacaacttgcctaagtaacatacagctaattagtcgaggagcctgacgcatgttgctctagcctggtcacagttacagaggtggcaagcaatggcctgaacaggacgaacaaccaaatacccaggctggtggctcttaaacatggtggggtcagctaacgacagcaaccagggtgggcactggtgcccctcgcccccggctggtgccctaacatctcccttttctctaccagttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactgtgagtatcaagaggcctaagcaatggtaatctccactctccattcttcccctgtggccagacacttcccctggctgagtctctgggcttttatatcataggatgcctctaatggcaatcctgccattagatacacctgccgtggtgtatctgccaggtaggcaggctaggctgcagtaacacacaagcccacaatttccatggcttaacactataggaatatatttcttgctcatgtaacaagctaacgtgaatgttgctggtttgtaggtggtttccctccctgtagaaatctggggagtgaggttctttccatcttgtggtgccatcattctccaggacaaagattcttacctacttttgtgtcctggtttcctttggcagcctggtgaagcctatggacctcatttcagaatatttttaaatacataaaatcccagcctgggcaatatagtgaaacccccatctgtacaaaaattagccaggcatggtggcatgcacctgtagtcccaggtactgggaaggctgaggtgggaggatcacttgagcccaggagtttgaggctgcagtgagccgtgatcgtaccactttactcccacctgggtgacagagcaagagcccatctctaaaaataaataaatacaatgaaataaaataaaataaatagaactacagaggaaactaattgtattgaaatgcagttataaaacatttaaacacatttttaatctagagatatatgtgcttctttattaagatctataaataataagttctaggggtagctcacataaatactgtaatttcaaagtagataagcataaataatactttatgatactgaaattgtgatgtgatatgagaatagctgtgagttttgttttgctggggacaggatcactgatgctgtcattactggggtctcttccctccattctttttttaaaattgtattttattttatttttaaaattttaaaataaatagagacagggtatcactatgttgcccaggctgcttttgacctcctgggctccagtgatcttcccatcttggcttcccaaagtgctgggattacaagtgggagccagtgttcctggccccttcctccattcttaatggaaggagatgctaggtgtgagaggttagggaaagtaaagatgtaatttctttcccatccaagttctcagacccctgaattctacctgcagccatgttggtccatcaaccccaagtgaagaatccctgctctagggccccaccattgtctgtatccagccagcagaagaggcgtgattatggagatcacatctgcttcttgaaagcagacagcccggaagtgggccgcatcacttcctctcaaattctattggtgaaaatggtcacatgactacacatagccacaaaggaggctgggaactttctcacttggaacctacatcccagaaacaactcttttcagtgaggtatcccacaggtctttcgcagtagaaatattgattatctcacataaaatgaagtcttacaaatggacctactgggttttgtacagcagccaagtgatatctcttcccttctgctgtcttcccttctgccatccttcacatggtggcattgtatccttagacttgccacccatgccctcaggttggccgttgcacactgtcttacataaagcaggaaggaaaggaaaggctgctacgagagagtgtaccttgtgcatctcttttttaatcaggaagcaaacatctttctagaagcttccctagcaaaattccccttacatctcattggccaagactgttacatgttacatggttactgttattacttgctcattgcaaggaagactgggaactcaaatgcctggaaaaaggaacaggataatcgtgattggctcaagccttagggtgggcatggctccctgacaagggagagaggaaaaagctgttgagtgaagaagactgcttcagtttccccatctgtataatgggaggagtaagggctgtcgtgaaaactcaatgaaagaagattcttcaacgtggtaggtgcagtggcagctggcagtaccctgaccctgccaccgcacagccctctcagcattgctcatcctgcactgtggatatcagttgagccacgtgtctcctgccctgggctgtgagctccataggcagggtctccatggctgtatctccagaacccagcacagaaccaggtgcttgggaaagttttgaattgattctcatctgccattggcatggggaagggaactagcttgtatgaaacagataacaatgtatgggaccctcattcattatttcagcaaatatttgctgagttcctcctacatggctagccctgtgctagacactggggaatcggcgatgaacaaagcagatagaaatccccactcttgtggagctgacattctggagggagagacaaaaagcaaacatataaagaaagaaagaaatcacatggatctggatgacagtgagtgctgggaagaaaataaaagcagaggaaggggatggagcgatgggcagggggcaacggtagggagggtgtcggggaaaactttttggagaatgtgacgatgaaagtgaacaaggagaagtcaaccgtgttgagatgatggcagctaatgatgtggacaggccactctgttctgagtgcattatctattgattcatcatgtcatcctcgcaacagccctgcacgatcaattctgtcattaaccccatagtacagatgaggatgcggaggcacagagaagataagggacttgtcctgtgtcacacagcaaggagccatccggctcctaagttggtgcatttgacttctgtgcttccggaaagaaagagcagcaagtttaagatctggaggtggcactgagctttggaggagcagggggcaatgaggtggccggtgtgacgaggactcaatgtgcaagagggagagtggtggggagatgaggtggaggggtggtcggcggtcagatcgtggagggtctcggacgagggtcctgaccctgggtctccagtcctgggaagtggagcccaggctgtaccatggctgacctcagctcatggcttcccctcccacttccagcctacagggagcccttcgagcagcacctcctgctgggcgtcagcgtttcctgcattgtcatcctggccgtctgcctgttgtgctatgtcagcatcaccaagtgagtcctgggcccagtgctgccgagcagtccctctggagtgcagggtggcagggacttgcccctctagtctgcccctttgcagtcctctcagtcaataatacgtatttactgagcagctactacacaccttgagagtagagctgagaacatatcgacaaggaccccacttttttctttttttcttttttttttttttttgagacggagtctcactctgtcacccaggctggagtatagtggcacaatcttgcctaacagtaacctccgcctcccgggttcaagcaattcttctgcctcagcctccagagtagctgggattacaggcgcatgccactatgcccggctaattttttgtatttttggtagagatggggtttcaccatgttggtcaggctggtctcgaactcctgacctcatgatctgcctgcctcagcctcccaaagtgctgggattacaggtgtgagccactgcacccaaccaggactccacatttctaaaaccggcatcctactggggagactgaaaatacatatcaatcacaaacaggtggttttccatagtgacccactctctgaatgcactagaccagggtggaggccagagatcttctggggtgctttttgcaagggggaccaggataaggctctccaaggagggaaaatttgaggggggccctgactggggagaatgagctggccagggataagcaagatggagtcatcccacatccccttacaacactgggtgcctgggcaactgggggcatttgggggcatgtggtaggagccagaggaatttgcgacgattgccctgatggagtcaggagacctgggtttgaatcctggccttggagcttggtagctggcggccgacaagttgctgaaacccctgagcctggggttcctgctttgcagagtgacagtgatggtgagaacatatttcatcagccagaagaggccaaatcacagtaaaggctgagggaggagatgagtggcgagtggctgggaggtggtggaaggagcctcgtttccagagagctcttgccagcccttggaatcatggtgtctcagagcctcagtcctcccatctctgaaatgggactagcaagctcaacctcactaagtcaggattagaggtggctaaggattattaacatgattgatgaaagtgcccactcttggcccagcacacactaggtaggcagggaatgcaaattcccctccatatcttgtcactgatgcctccgagcaaccttggactgatcgccttgctctgagcctcagtttccccatcacctgtacctcttcccactccccatcactatatcccagcatgccagcctctttgctgttctttgtctttggtttcttgttttgttctgttttttagacagggtctcactctgttagccaggctgaagtgcagtggcgcggttacggctcactgcagcctccaattcctgggctaaagagatcctcccatttcaacttccagagcagctgggacaacaggcgcttgccaccacacctggctaattttcttattttaatttaattttattttattttttgggacagagtggagtctcaaaaaccaagctagagtgcagtggtgcgatctcgactcactgcaatctctgcctcccgggttcaagcgattctcctgccttagcctcccgactagctgggattacaggcgtgtgccacgacacccagctaatttttgtatttttagtagagatggggtttcaccatgttggccaggatggtcttgaactcctgacctcaagtgatccacccacctcgttctcccaaggtgctgggtacaggcatgagccactgtgcctggccaattttcttacattttgtagagactggctgtcacttatgtagcccaggctgatcttgaacttctacccctttatctttattcatggcacttattaccatgaatgaatgacctcatataagcatttctttcgtttttttttttttttctttgagatggagtctcatgttgtcccccaggctggagtgcagtggcgcgatctcagctcactgcaacctccgccttccgggttcaagcgattctcctgcctcagcctcctgagtagctgggattgcaggcgcctgccaccatgcctggctaagttttgcatttttagtagagacggtgtttcaccatattggccaggctggtctcgaacttctgacctcaggtgatacacctgccttggcctcccaaagtgctgggattacaggcgtgagccgccatgcctggcctcatataagcatttctgtctccatttatcatccatctttccctcttgaaggtcagtttcaccaaggcaggcatctttgtctcgttcactgttgtagcctcagggccaggcacagtgagtcaaacatagaaggtgctcaataaatatgtgtttatttattgaaaccatgggcagaggctaattcagaagcggtctgaggaccttacctcccagtgatgatgcaccatggccccaggcaggccaggaagagagaagggttgtgtttctccgtaggtcccccagcttcccaggccatcccaggccattccctggtcatttgccctcagctgctctgaaaaagggattgttgaggggaacctagaatcctctctctgcagtttgagtctttcctaatcccctggggtctcattcccactgaggacataggtggcctcctcaggaactctgtgctgggtaacagaatgcgggagtgtgaacctggctctgccacctaccagctgtcactccacctccttgggcctcactctcctcatctgtagaatagggttagcaatagaatccatgtcaccaggttagaatgatgagtcagtggtttgacctccagaaactaatcagcctgatctctgatgccaaataagtattggtgataacgaccacttttatgggaggagcgttcacctgtcaataattcagagatcaacaccttttccttttgtttttcaggattaagaaagaatggtgggatcagattcccaacccagcccgcagccgcctcgtggctataataatccaggatgctcaggtaggagtaggcgtggatgaggacatgtgggactgtgtacatgaagaagtgtggttcagaacacctgggctgttaaggaccttcactggcttctggaatggcaaatagacagtcaggagggttgcaggggagacagaggcagaagccgaatgaggtcattagcagaccagaggctttcccgcccttccccttggcaatcccagcctggggtgggcttctctggggttggtttcctgtttttttccctccccttgggagaatgacccttgggtcatcatcactgtgtcattccctggggaggtgccagtaccagggctagaggccagaaggagtggaggaaggagagggtgacaggctttctgtgtcttcttcttaagcataggaaactgcccccgaagcactagcaaatcccttccgggttctcattggcctgaaatgtatcccacccctaagccaggggtggagtcagcttccccaaggcgatggtcctgtgggtgagtgggtggggtttgcctgagcaagatgagagttctctaggtaggagaaagggggattataggtcctgtctagaagagaaggtctgagggtccttgcttttccagggactctggaatctagtggtgttggctttgaatcctgactctgccactcactggcagtgtggacttgagcaagttgcttaattctctgagcctcagtttcctcttgtgggttataacagtgtttacctggtaggacagatattggaatttattgagacaatacatataaagtgcatattccagcctcttgcaaataccaagtgccatttatgtatcagttagtgtttgctgtgtaacaaatgaccccgaaatgtagagggttacaacaactttatttagcttatgcttctgcaggctggcatttggggctgggctcagcagtgagggtggcgggggaggctgggctgggctgggctgggcagatctgaattgagctgacccgtccccgtagcctccctccgtgtctgacagttggctttttttttttttttctttttctgagacggagttttgctcttattgcccaggagtgcaatggcgtgatcttggctcactgcaacctctgcctcctgggttcaagcaattttcttgcctcagcctcccaagtagctgggattacaggcatgtgccaccacgccaggctaattttgtatttttaatagagatggggtttcttcatgttggtcaggctggtctggaactcctaatatcagatgatccacccacctcagcctcccaaagtgctgggattacaggcgtgagccactgcacccagcctagttggctgacttttacctgggacagtgcaggtgcctgagccatgtgcctctcactctccagcaggccggcccaggcttgtttacagagtggctcagttttcaagggtgggaagtcccaaggcttcttgaggcctaggcgcagcactggcatgatatcacttccatcacattctatgggcccaagcaagtcccagggccagtgtagattcaagggatgggaggagattcagagcactcctctgtggccacttttgccatcgaccacagtccctgtaaatattaggacaatgtaattaattcccaggaatctgaggctcagaaagcgtaagtgacctgttggacttctgatctgtgtgatgtcgaggcttgtaccccttcctgagcattgccgtactccaggccgggctgcaaggccactctgctctttcattggctgtctctgtattttaggggtcacagtgggagaagcggtcccgaggccaggaaccagccaagtgcccgtatgtatctgaacttaggtcacagcctgcatgcattgggaaggtgatagaattggagaggcaagcccctagctccatgtctgccttctcttccctgcattcggtaattgccctgtgacattagccttcaagggacggcaggaggaggggtgttctggaaacgtggactgctggccaagccccctgagtttcactggtgtgtcaggtacatggtgataccccttgggagtgctgttatagttaacaaccagagcagccgtgcctgttgttaaaatcttgacctaattgtatacttgtcggcaaatagccactatcctgaacactcccctccttttttttaatatacaggatctcactctgtggcccaggctggtgtgcagtggtgcgatcatagctcactgcaccttcaaactcctgagctcaagtgatcctcccatcttagcctcccgagtagctgatactacagatgtgcattaccacgcctggctattttaaaaggtttttgcctgtaattccagctactcaggaggctgaggcatgagaatcacttgaacccgggaggcagaggttgcagtgagcgcagattgtgccactgcactccagcctgggcgacagagtgagactcttgtctcaaaaaaaataataccaaaaaaagtttttgtaaagacaagctctcgctgtgttgccccgccactgtggcctccttagcttcttccctggggcctgctggacctttccatactccagaaactaaagggggtccaggaccctgcttcaaccctaggatcccgcatcttttttttttttttttttttttggacgcagggtcttgctgtgtccctcaggctggagtgcagtgattcactgcagcctcaaactcgtgggctcaagtgattctctagcctcagccttctaagtagctgggactacagtcatacaccaacatgcccagctaattttccttttttttaattcttgtagagatgtttgagacggcttgggctctgttgcccaggctgttctcaaactcctgagctcaagcgatcctccctcctcagcctcctaaagtgctgggattacaggcgtgagccaccgcacccggcttccatatcctttctaattggtcatggcttgggataatggtgttgcttttaattatcatcatccataaagactttttcttactcaacagatctgagcttgtatttggtgcccaggacatgtgctgggttcccgaaatcccaaagacacagaccctaccctcagggatttctcattctagcaacatagactgatcaattactgattataacgttagaaggcatgtctgaagtagacagccatcaggacatggtgatttcaggctgggctttgaagaatgaataggagtttttcaagtgtcgaaactgaaccctgaccaacctttgcttttgcagacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacatggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctgtgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctctttattttttatgtattaaccaaacatacctccagacactgctgtgagtgctgtgtctctgttaactcctggaattcacccatccagaggaaccaggatgcaagaggttaagaaacttgccgtctgggtttgggttccccatacaaggattcaaatagttgatttaggaagtaatcccgggaaaccctgctaaggtagtggggaactgaggcagggaaggacacaaaccaagaaagtgttacctgaaaggggtccagatgcagaccccaaaagagggttcttgaatctcatgcaagaaagaattcagagcgagtccatagagtcagtgaaagcaagttaatgaggaaagtaaaggaataaaagaatggctactccgtagacagagcagccctgagggttgctggctgcctatttttatggttattgattaattatattccaaacaaggggtggattattatgcctcccttttagaccatatagggtaacttcctgatgttgccatggcatttgtaaactgtcatggcgctgttgggagtgtagcagtgaggacaaccagaggtcactcttgttgccatcttggttttggtgggttagagccatcttctttactgcaacctgttttatcagcaaggtctttatgacttgtatcggtgacgacctcctgtctcattctatgactaagaatgccctaacctcccaggaatgcagcccagtaagtctcagcctcattttacccagcccctcttcaaagctccagtttaaataaacctctgacaaaagggtgagttattcaacagattaccagcatgagtaactgatgcttacctgccggggatctctggaagaccatgcatggcacatgcccagttatgcctgcaaaggagagggagctggggtatttgtccaccagctcccatctgtcattggctgagagctgcttccaggagcattaattctccagcacttccagctactccaggaaaaaaaaaattcttcaactgagagttggaggtgttgagagactctggcacaccaagaagacaggaacaggacaccaacagtggctgatgatacactgccaaggtcacacagctagttagcaacagatctatagtggaatccagacagtgtctccatcacccaggctctctgtagtgatctgcgcttcacatccgaggcaggcagagggatggtgtgggccttagatgggaaggctgggaacctgaagctcctatgtctgtatcacttttgcttctctgagtagctgccctgatttcacacttgaggggcttggccattttagattccttcctgctctaggagcctacatactacactggaaatgatggggagctctctacctcacatgcagcctgatgtttgttagaaacacctccttgcgccaggcatgatggctcatggctgtaatcccagcaatttgggaggctgaggcgggtgtatcacttgaggtgaggagttcaagaccagcctggccaatatggtgaaaccctatctctaccaaaaaataaaaaattagccgggtgtggtggtgggtgcctgtaatctcagctacttgggaggctgagttggtagaattgcttcaacctgggacgcggaggttgcagtgagctgagattgtgccattgcactccagcttggatgacagagtgagaccctgtctcaggaaaaaaaaaaaaaaacaaaaaaaaccttgttctaagccaaaatcaatccctttagctgcccaaatcacacagtttacagatggagaaacagttttagagaggaaaagggacttgcccaaagtcacccagagaatggcagagcctgaactagccttctggacttcttgcctccaaaagctctttataataaaatataattttaaataaaaatagttatctgtttagggccaagcaatatgctaagtgccgtccagccactgtgtcatttacgtctccaaacagctctagttgggaggctcaatgattatcccaa

SEQ ID NO: 40 - DNA, 601 bp, Human
aataataaaatattagccaggtgtggcagtgcacgcctgtagccccagctactcaggaggccgaggtgggaggatcccttgaactcaggaggtcaaggctgcagtgaactgtgatcgcgccactccactccagcctgcgtgagaaagtgagaccctgtcaaaaaaaaagagaaggtgatggggaaagaacacagaacagcataagagggggttggggaagctgggtggagtgggggggattgcagttgaaagtagggaagtcagggaaggcctcattgagctgacttggaggaagcgggamccgtgcagatgtctggggaaggctcattcttggcagagaggccctgcactgagcctggcgggagggttgagcacaggagggaatgtggtggaggagagtgagcagcaggagggagcagtgaaggtcagcaaggtgacagagtggctgaatcaaaaaagaccttgcagtgtttgagcagaggatccatatcatccattatgttccaaaggactcttcaggatgccgtgtggagaaaggaagagggtggaagccaggaggtctggagggaggtctggagtggaggagatgagaggctccgga

SEQ ID NO: 41 - DNA, 601 bp, Human
agaaaggaagagggtggaagccaggaggtctggagggaggtctggagtggaggagatgagaggctccggatccctctgggaggtagatttgaggacagattggaattgaggtgaaagacagagaaagagaagtggccaggatgactccaagatttctgacctaaactactgggaaggacgcggttgtcatttctgaaatgcagaaggatgccagaagagaaggtactttggggaggggcgggaatcaggagttagttttggacatgagataagcttggaatatttatttgctatctaagayagctccttaacatggtaagcccttatgcaagttgttgtcagctgagatgggcgtggcactgagcatgggagcatggaggcgcctgagtggtctcatgctcaggtggtttagcaaactcagtgtacatcctgccaattccagtcctgccatggccactgacaagctaggagggcgctgaaaggagaaggaccccgatgtctcctccagcccatccatctcctctctcccattggccaaacccaaccggaaactaaaggccaagggtacccggtgatgaagactgtggtatcagcctcctga

SEQ ID NO: 42 - DNA, 601 bp, Human
tgaggtgaaagacagagaaagagaagtggccaggatgactccaagatttctgacctaaactactgggaaggacgcggttgtcatttctgaaatgcagaaggatgccagaagagaaggtactttggggaggggcgggaatcaggagttagttttggacatgagataagcttggaatatttatttgctatctaagacagctccttaacatggtaagcccttatgcaagttgttgtcagctgagatgggcgtggcactgagcatgggagcatggaggcgcctgagtggtctcatgctcaggtgrtttagcaaactcagtgtacatcctgccaattccagtcctgccatggccactgacaagctaggagggcgctgaaaggagaaggaccccgatgtctcctccagcccatccatctcctctctcccattggccaaacccaaccggaaactaaaggccaagggtacccggtgatgaagactgtggtatcagcctcctgagcacagagagggcagaaaggggtggagacaaagaggggcgcagatagtgggcaaatggggaagtggcacttcccctagctcgagggcagaggcttggtgtgatgga

SEQ ID NO: 43 - DNA, 601 bp, Human
ctcctctctcccattggccaaacccaaccggaaactaaaggccaagggtacccggtgatgaagactgtggtatcagcctcctgagcacagagagggcagaaaggggtggagacaaagaggggcgcagatagtgggcaaatggggaagtggcacttcccctagctcgagggcagaggcttggtgtgatggaatggcactccttaaactgctacatattttccctttaatttggccaagaacaagttgtcaagtttgtgtgagataaaggtgcacttggttcgttcttgtctaatggcccccrcacccatgggtatttcttcagcttccacagtcatcccgacactagctgggaagctccagcagccctggtcctggccccagctctgtgggcgctggccctcaactttgcctgcactgtgcttttgtgctattccccttggtcctgtttgggtgcaagtccccctcacgcattgagttcctgggccgctcaggctgctcctgtgtctccccagggaacatgaaggtcttgcaggagcccacctgcgtctccgactacatgagcatctctacttgcgagtggaagatgaatggtcccaccaat

SEQ ID NO: 44 - DNA, 601 bp, Human
atagtgggcaaatggggaagtggcacttcccctagctcgagggcagaggcttggtgtgatggaatggcactccttaaactgctacatattttccctttaatttggccaagaacaagttgtcaagtttgtgtgagataaaggtgcacttggttcgttcttgtctaatggcccccgcacccatgggtatttcttcagcttccacagtcatcccgacactagctgggaagctccagcagccctggtcctggccccagctctgtgggcgctggccctcaactttgcctgcactgtgcttttgtgytattccccttggtcctgtttgggtgcaagtccccctcacgcattgagttcctgggccgctcaggctgctcctgtgtctccccagggaacatgaaggtcttgcaggagcccacctgcgtctccgactacatgagcatctctacttgcgagtggaagatgaatggtcccaccaattgcagcaccgagctccgcctgttgtaccagctggtttttctgctctccgagtaagcctgcgctggagctggaggtttggggaggttgtgcccaaagggtttgccccaagagtgagctgggtccaggt

SEQ ID NO: 45 - DNA, 601 bp, Human
gtgggagtgttggtccacgtggcacatggatacggctggaatactggactagaccagcagttctcacactttttggtctcaggaccctttttcacacttaaaaatgagtgaggacccaaagggctttggtgtaggtaacacatcattctatgtttacctaattagaacttgcaatgaagaaatggtgtaatttttaaaaaattaaaacaattaaaaattttttttcttactgaaatggaggtctcactgtgttgcccaggctgctctcaaactcctgggctccagtgatcctcctgcctcmgcctcccaaagtgctgggattacaagcgtgagccgctgtatccggcccaaaatggagaaattttaagtcccaacaacatgcaagcccgcattcaacaaatcttcagatcaattacatgatcacaggtcatgtagcctctagaaaattccactgtacgccagtgagagagagtgaaaaggcaaataacgtccctgtattatgatgaaaagagttttacctggtgggcccagaccacactttgagaaccactggactagacccttgattgaggagtacggtgttgagagtggagtcctctgt

SEQ ID NO: 46 - DNA, 601 bp, Human
agagagagtgaaaaggcaaataacgtccctgtattatgatgaaaagagttttacctggtgggcccagaccacactttgagaaccactggactagacccttgattgaggagtacggtgttgagagtggagtcctctgtgatggtggatggaccaggacacatggcataggagtcaggtggttccctgggctactccatggtgcacaggatgcttcgttacactggtgcccaggacataatcacgtacacaagacacacagttacggggcagactggggatatacggcacaccagcatgcagsgttcaccagtaaaggtggtattccatgattattctaaggtagatgggctgtgctttgtttccattggcttagtccagggattggcaaactatggcccgtgagccaaatccggcccactgcttgtttttgtaaataaagttttattggaacacactggctgctgtagttgtaacagaaactgcatggccctcctttatgttttttgtttgtttgtttgtttgtttgttttctttgagacagagtttcgctcttgttgcccaggctggagtgcagtggcacaatctcggctcactgcaacct

SEQ ID NO: 47 - DNA, 601 bp, Human
ggatgcttcgttacactggtgcccaggacataatcacgtacacaagacacacagttacggggcagactggggatatacggcacaccagcatgcagggttcaccagtaaaggtggtattccatgattattctaaggtagatgggctgtgctttgtttccattggcttagtccagggattggcaaactatggcccgtgagccaaatccggcccactgcttgtttttgtaaataaagttttattggaacacactggctgctgtagttgtaacagaaactgcatggccctcctttatgttttttttttgtttgtttgtttgtttgttttctttgagacagagtttcgctcttgttgcccaggctggagtgcagtggcacaatctcggctcactgcaacctctgcctcccgggttcaagcgattctcctgtctcagcctcccgagtagttgggattaatggtgcctgccaccacacccggctaatttttcgtatttttagtagagaccggttttcatcatgttggccaagctggtctcgaactcctgaactcaggtgatccacccgcctcagcgtcccaaagtgctgggattacaggcatgagcca

SEQ ID NO: 48 - DNA, 601 bp, Human
cagaaactgcatggccctcctttatgttttttgtttgtttgtttgtttgtttgttttctttgagacagagtttcgctcttgttgcccaggctggagtgcagtggcacaatctcggctcactgcaacctctgcctcccgggttcaagcgattctcctgtctcagcctcccgagtagttgggattaatggtgcctgccaccacacccggctaatttttcgtatttttagtagagaccggttttcatcatgttggccaagctggtctcgaactcctgaactcaggtgatccacccgcctcagcstcccaaagtgctgggattacaggcatgagccactgagcccggcctcctcctttatcttaattgaaataattcagaaatggaaagtcaaatactgcatgttctcacttataagtaagagttaaataatgtgtacacatgggcattattccatgtaccatggaataacagacattgaagacttgggagggtgggagaggggtgaaggaagagaagttacttaatgggcatagtgtacaccatttgggtgacggacccaccagaaccccagacttcaccactaggcagcatatccagtgagaa

SEQ ID NO: 49 - DNA, 601 bp, Human
gtgatccacccgcctcagcgtcccaaagtgctgggattacaggcatgagccactgagcccggcctcctcctttatcttaattgaaataattcagaaatggaaagtcaaatactgcatgttctcacttataagtaagagttaaataatgtgtacacatgggcattattccatgtaccatggaataacagacattgaagacttgggagggtgggagaggggtgaaggaagagaagttacttaatgggcatagtgtacaccatttgggtgacggacccaccagaaccccagacttcaccactakgcagcatatccagtgagaacagatctgaggcttgccatcaaaattgcacttgtaaggccgggcactgtggtggctcgcggctgtaatcccagccctttgggaggccgaggtgggcagatcacttgaggtcaggagttcgagaccggcctggccaacatggtgaagctccatctctactaaaaatacaacaattaactgggtgtagtggcgcacacctgtaatcccagctactagggaggctgaggcgggagaattgcttgagcccaggaggtggaggttgcagtgagccgagatcacatc

SEQ ID NO: 50 - DNA, 601 bp, Human
tcctcctttatcttaattgaaataattcagaaatggaaagtcaaatactgcatgttctcacttataagtaagagttaaataatgtgtacacatgggcattattccatgtaccatggaataacagacattgaagacttgggagggtgggagaggggtgaaggaagagaagttacttaatgggcatagtgtacaccatttgggtgacggacccaccagaaccccagacttcaccactaggcagcatatccagtgagaacagatctgaggcttgccatcaaaattgcacttgtaaggccgggcrctgtggtggctcgcggctgtaatcccagccctttgggaggccgaggtgggcagatcacttgaggtcaggagttcgagaccggcctggccaacatggtgaagctccatctctactaaaaatacaacaattaactgggtgtagtggcgcacacctgtaatcccagctactagggaggctgaggcgggagaattgcttgagcccaggaggtggaggttgcagtgagccgagatcacatcactgtactctagcctgggtgacagtgagactttgtctcaggaaaaaaaaacaaaaacaaaaaac

SEQ ID NO: 51 - DNA, 601 bp, Human
taattgaaataattcagaaatggaaagtcaaatactgcatgttctcacttataagtaagagttaaataatgtgtacacatgggcattattccatgtaccatggaataacagacattgaagacttgggagggtgggagaggggtgaaggaagagaagttacttaatgggcatagtgtacaccatttgggtgacggacccaccagaaccccagacttcaccactaggcagcatatccagtgagaacagatctgaggcttgccatcaaaattgcacttgtaaggccgggcactgtggtggctcrcggctgtaatcccagccctttgggaggccgaggtgggcagatcacttgaggtcaggagttcgagaccggcctggccaacatggtgaagctccatctctactaaaaatacaacaattaactgggtgtagtggcgcacacctgtaatcccagctactagggaggctgaggcgggagaattgcttgagcccaggaggtggaggttgcagtgagccgagatcacatcactgtactctagcctgggtgacagtgagactttgtctcaggaaaaaaaaacaaaaacaaaaaacaaaaaactcgtac

SEQ ID NO: 52 - DNA, 601 bp, Human
atgggctttcaggaacaagctaagtcccaggaccagggccggcagctaggcaggtgtgaggagcatccttggtgcatgtggtaagaggctgtggccagcaagagaggcaaccctagtcggctgccccagcacaccctggccgctcccaagcccccagatctgtcctcacatccgtgatcgggaagctggaagagtctgatgcggttcctggaggcatgtcccggacacagctgtggggcccagccagcctacaggtgaccagcctaacccagcccctgtgtctgcagagcccacacgtgtrtccctgagaacaacggaggcgcggggtgcgtgtgccacctgctcatggatgacgtggtcagtgcggataactatacactggacctgtgggctgggcagcagctgctgtggaagggctccttcaagcccagcgagcatggtgagcagggcggagtgcggcaggggtggctgggtgtgttcccacagctgcctgggctgagggtggggtgggcaggggaggaggtggggtcatagcaacagcaggaggaagccgcctgtattttcccaaatctgatgggattcctgcccctgcctgggcctc

SEQ ID NO: 53 - DNA, 601 bp, Human
gtggctgggtgtgttcccacagctgcctgggctgagggtggggtgggcaggggaggaggtggggtcatagcaacagcaggaggaagccgcctgtattttcccaaatctgatgggattcctgcccctgcctgggcctcagtcctcccacctttgaaacggagctggtcgcagtagaccaccaagcccccttcagcccagctgtttccacccctgaacttaagtgcccaggaaggcgtattgagatgaggtgtgcttgctggaaggcatgcctgctgctgattgaaaaccgaactgggaacaktccttccattctgtgtccactggtcagctgctgcggctttggatggtcttgaccgtggaaggctgaccttcttctggtacccggagtccctgcaggaatcccccttgagcttgctgggctgtggtgacaggagtttaaaacatgcgttgtattccagtgatgcatgatatgacatgcatcacaggaataaaaacctgaggtctcatggatatgattgcttcaaaggagaccaagttttaaaacagatgaatcaaaataaagaaaaatactcagtaaatcatcataaagtacagagatgtg

SEQ ID NO: 54 - DNA, 601 bp, Human
tgcagtgagctgggattgtgccactgcactccagcctgggcaacagagtgggaccctgtctcaaaaaagaagaaaaaaagggtaattaataaacactaaagttctatgtagaattttagcaacattattgttattataatcttctttgctatggctctgaatctgtgtggtgctccagaagtatgctatggaggttttgtcgaccaaaaatctgggtggtggctgtggtttgtaggccggggctgggctgggtgatgggggagtcactgcatagatcctcacatagaggccgcttctcccrcagtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatgtgagtgggcatgctttgacgtttttctgtgacctctggggaacagggtgggtgaccagcagaggcccagtccctggagccaggagcctgggaggcaagccctggggctggatagcaaatcccaggagctagagacctggcttct

SEQ ID NO: 55 - DNA, 601 bp, Human
ctttgctatggctctgaatctgtgtggtgctccagaagtatgctatggaggttttgtcgaccaaaaatctgggtggtggctgtggtttgtaggccggggctgggctgggtgatgggggagtcactgcatagatcctcacatagaggccgcttctcccgcagtgaaacccagggccccaggaaacctgacagttcacaccaatgtctccgacactctgctgctgacctggagcaacccgtatccccctgacaattacctgtataatcatctcacctatgcagtcaacatttggagtgaaaaygacccggcagatgtgagtgggcatgctttgacgtttttctgtgacctctggggaacagggtgggtgaccagcagaggcccagtccctggagccaggagcctgggaggcaagccctggggctggatagcaaatcccaggagctagagacctggcttctcacctggctctgccctaggcaagtccctttgcttcctggccccccacccctcacatcagagaaggggagttatctctgcatgccgctcctcctctgtaaaggtagggctgtgggccacatctgtgtttcccagtttgggggac

SEQ ID NO: 56 - DNA, 601 bp, Human
tccgacactctgctgctgacctggagcaacccgtatccccctgacaattacctgtataatcatctcacctatgcagtcaacatttggagtgaaaacgacccggcagatgtgagtgggcatgctttgacgtttttctgtgacctctggggaacagggtgggtgaccagcagaggcccagtccctggagccaggagcctgggaggcaagccctggggctggatagcaaatcccaggagctagagacctggcttctcacctggctctgccctaggcaagtccctttgcttcctggccccccacycctcacatcagagaaggggagttatctctgcatgccgctcctcctctgtaaaggtagggctgtgggccacatctgtgtttcccagtttgggggacacaagtgatcgtaggtggcacattgacagctcacttgaataaccctattattgaagagaataatactgactcaagagacagtgacccgtgtcagttcccttttgaggccaacgggttaaggaggaagtccccatacagctgactcgtttactaattcctcttaatgaagagagcagaggccacaccccaggcttagactttccca

SEQ ID NO: 57 - DNA, 601 bp, Human
atcatctcacctatgcagtcaacatttggagtgaaaacgacccggcagatgtgagtgggcatgctttgacgtttttctgtgacctctggggaacagggtgggtgaccagcagaggcccagtccctggagccaggagcctgggaggcaagccctggggctggatagcaaatcccaggagctagagacctggcttctcacctggctctgccctaggcaagtccctttgcttcctggccccccacccctcacatcagagaaggggagttatctctgcatgccgctcctcctctgtaaaggtagrgctgtgggccacatctgtgtttcccagtttgggggacacaagtgatcgtaggtggcacattgacagctcacttgaataaccctattattgaagagaataatactgactcaagagacagtgacccgtgtcagttcccttttgaggccaacgggttaaggaggaagtccccatacagctgactcgtttactaattcctcttaatgaagagagcagaggccacaccccaggcttagactttcccaagaaaacaagatcagtttgttggttgttccccatggaagctggtcctgacattccctt

SEQ ID NO: 58 - DNA, 601 bp, Human
tgcagtcaacatttggagtgaaaacgacccggcagatgtgagtgggcatgctttgacgtttttctgtgacctctggggaacagggtgggtgaccagcagaggcccagtccctggagccaggagcctgggaggcaagccctggggctggatagcaaatcccaggagctagagacctggcttctcacctggctctgccctaggcaagtccctttgcttcctggccccccacccctcacatcagagaaggggagttatctctgcatgccgctcctcctctgtaaaggtagggctgtgggccacrtctgtgtttcccagtttgggggacacaagtgatcgtaggtggcacattgacagctcacttgaataaccctattattgaagagaataatactgactcaagagacagtgacccgtgtcagttcccttttgaggccaacgggttaaggaggaagtccccatacagctgactcgtttactaattcctcttaatgaagagagcagaggccacaccccaggcttagactttcccaagaaaacaagatcagtttgttggttgttccccatggaagctggtcctgacattcccttcacagtagtgttg

SEQ ID NO: 59 - DNA, 601 bp, Human
atagcaaatcccaggagctagagacctggcttctcacctggctctgccctaggcaagtccctttgcttcctggccccccacccctcacatcagagaaggggagttatctctgcatgccgctcctcctctgtaaaggtagggctgtgggccacatctgtgtttcccagtttgggggacacaagtgatcgtaggtggcacattgacagctcacttgaataaccctattattgaagagaataatactgactcaagagacagtgacccgtgtcagttcccttttgaggccaacgggttaaggagraagtccccatacagctgactcgtttactaattcctcttaatgaagagagcagaggccacaccccaggcttagactttcccaagaaaacaagatcagtttgttggttgttccccatggaagctggtcctgacattcccttcacagtagtgttggtggagtttttgttgttgtttgttttgagacagagtctcactctgtcacccagggtggaacacagtggcgtgatcttggctcactgcaacctccgcctcctgggttctagcgattctcctgcctcagcctcctgagcagccgggacta

SEQ ID NO: 60 - DNA, 601 bp, Human
ccatggaagctggtcctgacattcccttcacagtagtgttggtggagtttttgttgttgtttgttttgagacagagtctcactctgtcacccagggtggaacacagtggcgtgatcttggctcactgcaacctccgcctcctgggttctagcgattctcctgcctcagcctcctgagcagccgggactacaggcacctgccaccgtgcccagctaatttttgtatatttagtagagatggggtttcactgcgttggccaggctggtctcaaactcctgacctcagatgatccactcgcctyggcctcccaaagtgctgggattacaggtgtgagccaccgcacctggccagtggagttccttcttaagtacatgtattgacatctttaaaaagggcgagaggatttacaggaaactatcaggtcagtaatggcaggggccgtccacagtgggtggctgagtccccctatttttctgctggtgtgcggggaggtcatttcctgccacccatgtttccccaccctgaatccaccttcctcacattcccattggagggacactctctggacatatgggacctggggtcccacagggctgcattc

SEQ ID NO: 61 - DNA, 601 bp, Human
actacaggcacctgccaccgtgcccagctaatttttgtatatttagtagagatggggtttcactgcgttggccaggctggtctcaaactcctgacctcagatgatccactcgcctcggcctcccaaagtgctgggattacaggtgtgagccaccgcacctggccagtggagttccttcttaagtacatgtattgacatctttaaaaagggcgagaggatttacaggaaactatcaggtcagtaatggcaggggccgtccacagtgggtggctgagtccccctatttttctgctggtgtgcrgggaggtcatttcctgccacccatgtttccccaccctgaatccaccttcctcacattcccattggagggacactctctggacatatgggacctggggtcccacagggctgcattccaatgcctgctgtgccactcgccagctgtgtgatgttgggcatatcccataacctctttgtgcctcagtttcctcatctgtaacacaggagtgacaagagcacccgcccacagggctatgacagtacaaggtgtgtgatacagatgagctcccctgtttggcccacatgtgtcctaaaagccatg

SEQ ID NO: 62 - DNA, 601 bp, Human
tcctcacattcccattggagggacactctctggacatatgggacctggggtcccacagggctgcattccaatgcctgctgtgccactcgccagctgtgtgatgttgggcatatcccataacctctttgtgcctcagtttcctcatctgtaacacaggagtgacaagagcacccgcccacagggctatgacagtacaaggtgtgtgatacagatgagctcccctgtttggcccacatgtgtcctaaaagccatgtgccctttctcttgagtgccccaggccacagagatccccatctgcccrctgtcccacacactggtctgtcatttgttccttgaggtttgtgagggccggctctgtgcatcccaggggcccaggctgggcctggttggctctcagggagcaggcacccgccaccttaagctcccatgctggtgtctgtcactgcttcctctcaatctggccaagccaggggtgtcgatttatatctctcaggtctggtttcccctttggcactgggccaggtatggggaaagagcaggaatggggcagttggctcacacagcagaggctcagaaagcggggggcatggggggaaggagt

SEQ ID NO: 63 - DNA, 601 bp, Human
agttggctcacacagcagaggctcagaaagcggggggcatggggggaaggagtgcacagatgctagagagtggggcaagttttgtttggtcaataaatctccttctcatgccccaggcctgtgcaagacctacagagagtcccaaggatgggctggggggaagagaaaggtaccaccttcagagtccaaagatatgttatttaatattttcatatttctagatctgccttcaggcatggctggatccagcttctaggaacctgtccagctctgcgccctgctttattctgtactggcttcrtttttaggcaggctcttccctcatgtagtggcagatatgcctactagttgctccaggcctacatcccaaagccacagtgggaaaagggttttttttcttgacggttctaataagagtcctaaggctgctgctcagtggcctggcttcgatgctgtgccagcctctgaaccaatcactggctgtgggtggagagagggtgctggtggagggccctgcttgtccagggaggagtcacatacctgcctctagggctgcaggtgggctcagctccatccaaaccagatgaactgaaaataaggc

SEQ ID NO: 64 - DNA, 601 bp, Human
gttttttttcttgacggttctaataagagtcctaaggctgctgctcagtggcctggcttcgatgctgtgccagcctctgaaccaatcactggctgtgggtggagagagggtgctggtggagggccctgcttgtccagggaggagtcacatacctgcctctagggctgcaggtgggctcagctccatccaaaccagatgaactgaaaataaggcaggagtggcttccccaggggaaactggggaagaggaagcaggactgtgctggctaaaatgccagccaggtttaagacgtggcaccagatgccagtcatgggattggattggtcagcatgcctgggctatggcttaggggtatgttggtgctcagggatgccacaggcctccagataccaggtctgaggcagaagaatgaagtccagcttctcttgtgggtggaacagtggcaactgagataccccatctctcccttcccaagaacagagctgaacataaagaatttagtgattggccagagcttggccacatgctcccctctgatgaatgataggccaggtgatgggattggcacaattggcttagactaatgagggttggccctgga

SEQ ID NO: 65 - DNA, 601 bp, Human
ctgaggcagaagaatgaagtccagcttctcttgtgggtggaacagtggcaactgagataccccatctctcccttcccaagaacagagctgaacataaagaatttagtgattggccagagcttggccacatgctcccctctgatgaatgataggccaggtgatgggattggcacaattggcttagactaatgagggttggccctggagttgcaggcagtggagttctgtcctaagcagtgggcacctaaacccgatggcataaaagctgggcgggtgtccacctgcatctgccacagcactrtaggcaccaactgtggctcatactgagtgggataaattccagaaagaaacattaggaacttactatagaattttggggctagagctactcattcattcccctagataatttctaggcaaggttccatagtggagggggagttttggcttgggcattgaaggatgcataggagttttctagatggggaaagaagggaacggtagaccaggcagagggaactgcatgataaaaggtttatgggtgtgaaaattcatggaatgtttgaggattatggggttgggggatgtgggaatatgtgta

SEQ ID NO: 66 - DNA, 601 bp, Human
tgaggcagaagaatgaagtccagcttctcttgtgggtggaacagtggcaactgagataccccatctctcccttcccaagaacagagctgaacataaagaatttagtgattggccagagcttggccacatgctcccctctgatgaatgataggccaggtgatgggattggcacaattggcttagactaatgagggttggccctggagttgcaggcagtggagttctgtcctaagcagtgggcacctaaacccgatggcataaaagctgggcgggtgtccacctgcatctgccacagcactayaggcaccaactgtggctcatactgagtgggataaattccagaaagaaacattaggaacttactatagaattttggggctagagctactcattcattcccctagataatttctaggcaaggttccatagtggagggggagttttggcttgggcattgaaggatgcataggagttttctagatggggaaagaagggaacggtagaccaggcagagggaactgcatgataaaaggtttatgggtgtgaaaattcatggaatgtttgaggattatggggttgggggatgtgggaatatgtgtag

SEQ ID NO: 67 - DNA, 601 bp, Human
catagtggagggggagttttggcttgggcattgaaggatgcataggagttttctagatggggaaagaagggaacggtagaccaggcagagggaactgcatgataaaaggtttatgggtgtgaaaattcatggaatgtttgaggattatggggttgggggatgtgggaatatgtgtagcgataaagcaccaaacaaagccaaaagtttagttagagccctgaatgcctgcctcataatggtttccatattttatatgcctactatgtgccaggcacattgctcagggtcacacagctggaartggcagggctgagtttttgttgttgttgttgttgttgagacagagtctcactctatcacccaggctggaatgcaggggcgtgatcatggctcactgcatccttgacttcctgggctcaggtgattctcccacctctgcctcccaggtagctgggactacaggcacaggccaccacgccaggctaattttttgtatttttagtagcgacagggtctcgccatgttgtccgggctggtctggatctcctggcttcaagtgatccccctggctcagcctcccaaggtgctgggattacaggct

SEQ ID NO: 68 - DNA, 601 bp, Human
ggtgtgaaaattcatggaatgtttgaggattatggggttgggggatgtgggaatatgtgtagcgataaagcaccaaacaaagccaaaagtttagttagagccctgaatgcctgcctcataatggtttccatattttatatgcctactatgtgccaggcacattgctcagggtcacacagctggaaatggcagggctgagtttttgttgttgttgttgttgttgagacagagtctcactctatcacccaggctggaatgcaggggcgtgatcatggctcactgcatccttgacttcctgggmtcaggtgattctcccacctctgcctcccaggtagctgggactacaggcacaggccaccacgccaggctaattttttgtatttttagtagcgacagggtctcgccatgttgtccgggctggtctggatctcctggcttcaagtgatccccctggctcagcctcccaaggtgctgggattacaggcttgagccaccgcatccagcccagatctgagatttgcacccagtatttgaactcccaagcctgtgctctttttcctcccatggacatttctctcagagatggtctcccaaacacctg

SEQ ID NO: 69 - DNA, 601 bp, Human
tatgtgccaggcacattgctcagggtcacacagctggaaatggcagggctgagtttttgttgttgttgttgttgttgagacagagtctcactctatcacccaggctggaatgcaggggcgtgatcatggctcactgcatccttgacttcctgggctcaggtgattctcccacctctgcctcccaggtagctgggactacaggcacaggccaccacgccaggctaattttttgtatttttagtagcgacagggtctcgccatgttgtccgggctggtctggatctcctggcttcaagtgatmcccctggctcagcctcccaaggtgctgggattacaggcttgagccaccgcatccagcccagatctgagatttgcacccagtatttgaactcccaagcctgtgctctttttcctcccatggacatttctctcagagatggtctcccaaacacctgtccttcttgttaaaaaacagacaaaccgcaagtagttctttggaagctcagatttctcttttgtttcttagtaaaacatttcccagttcccagctcccttccagggtgtaagatttcttcggtaacttacatctagctgttgcttc

SEQ ID NO: 70 - DNA, 601 bp, Human
caagcaaatgtgtgtgttcagtcatcgctgtcttagttttctattgctgcataataatggtactaccagcttcacagctttaaacaacacccatttattatctcatagtttctgtggttgggagtctggacatagcttagccaggttctctgctttagagtctcgtgaggctataatcaaggtgtgggatggggctgcagtttcatctgaggctcaattggggaagggtcacttctaagctcatacaatattggtgacattcagtccctggcaggctgttgaactgagagcctcagtttcstgctggctgttggttgtagttaaccctgaattccttcccatgtgccctttgcaaagccatcaaggcagagagacttgcctagcaagtaggatattacagtcttctgtaatataatcacatccatgaaatcctctatatatcccatcacctttaccatattctgtgggttagaaacaagtagcaggtcctgcccacactcgagaagaccagatgacacaaagatgtgattcaaagtggggatcatcggggccatcttaggtttgtctgcagtgatcactgtgccatctctctctctctctt

SEQ ID NO: 71 - DNA, 601 bp, Human
accagatgacacaaagatgtgattcaaagtggggatcatcggggccatcttaggtttgtctgcagtgatcactgtgccatctctctctctctcttttttttttttttttttcgagacgaagtcgtcactctgtcacccaggctggagtgcagtggcatgatctcagcttaccacaatctctgcctcccaggttcaaatgattcttctgcctcagcctcctgagtagctgggattacaggtgcccgccaccacacccagctaatttttgtatttttagtagagacagagtttcaccatgttrgccaggctggtcttgaactcctcacctcaagtgatccacccacttcggcctcccaaagtgctgggattacaggcatgagccaccatgcccagccccatctctctttaaaaaacaaacaaacaaacaaaaaacataaaaagaagcagagaacacatacacatctgcatcttcccttgtttacttaacaatagatcttggaagtcacttctcagtagaggctaggttgggcagagcattggattctaggccagtgagtttggacttgaccatggagacactaggaagcccatgaaggacaga

SEQ ID NO: 72 - DNA, 601 bp, Human
tgacacaaagatgtgattcaaagtggggatcatcggggccatcttaggtttgtctgcagtgatcactgtgccatctctctctctctcttttttttttttttttttcgagacgaagtcgtcactctgtcacccaggctggagtgcagtggcatgatctcagcttaccacaatctctgcctcccaggttcaaatgattcttctgcctcagcctcctgagtagctgggattacaggtgcccgccaccacacccagctaatttttgtatttttagtagagacagagtttcaccatgttggccagrctggtcttgaactcctcacctcaagtgatccacccacttcggcctcccaaagtgctgggattacaggcatgagccaccatgcccagccccatctctctttaaaaaacaaacaaacaaacaaaaaacataaaaagaagcagagaacacatacacatctgcatcttcccttgtttacttaacaatagatcttggaagtcacttctcagtagaggctaggttgggcagagcattggattctaggccagtgagtttggacttgaccatggagacactaggaagcccatgaaggacagagagaga

SEQ ID NO: 73 - DNA, 601 bp, Human
tggagacactaggaagcccatgaaggacagagagagatgcctcgaccctgccagtcctttagaaagatcacccagtgctttttgtataccaaaccctatttgaaatacttacgtatattaacccatttccttatcaccacaaccctgcgggaagggagataggcacttttattatcttcattttgcagatgaggacattgaggtccagagaggttatgtcacttacttaaggtcacacagccaggaagtggtagtagggactcttacccttgttttacagatgagattgaattatctcacraaaactcagaaaggttaaacaacttgcctaagtaacatacagctaattagtcgaggagcctgacgcatgttgctctagcctggtcacagttacagaggtggcaagcaatggcctgaacaggacgaacaaccaaatacccaggctggtggctcttaaacatggtggggtcagctaacgacagcaaccagggtgggcactggtgcccctcgcccccggctggtgccctaacatctcccttttctctaccagttcagaatctataacgtgacctacctagaaccctccctccgcatcgcagcc

SEQ ID NO: 74 - DNA, 601 bp, Human
cagttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactgtgagtatcaagaggcctaagcaatggtaatctccactctccattcttcccctgtggccagacacttcccctggctgagtctctgggcttttatatcataggatgcctctaatggcaatcctgccattagatacacctgcygtggtgtatctgccaggtaggcaggctaggctgcagtaacacacaagcccacaatttccatggcttaacactataggaatatatttcttgctcatgtaacaagctaacgtgaatgttgctggtttgtaggtggtttccctccctgtagaaatctggggagtgaggttctttccatcttgtggtgccatcattctccaggacaaagattcttacctacttttgtgtcctggtttcctttggcagcctggtgaagcctatggacctcatttcagaatatttttaaatacataaaatcccagc

SEQ ID NO: 75 - DNA, 601 bp, Human
cgcatcgcagccagcaccctgaagtctgggatttcctacagggcacgggtgagggcctgggctcagtgctataacaccacctggagtgagtggagccccagcaccaagtggcacaactgtgagtatcaagaggcctaagcaatggtaatctccactctccattcttcccctgtggccagacacttcccctggctgagtctctgggcttttatatcataggatgcctctaatggcaatcctgccattagatacacctgccgtggtgtatctgccaggtaggcaggctaggctgcagtaacamacaagcccacaatttccatggcttaacactataggaatatatttcttgctcatgtaacaagctaacgtgaatgttgctggtttgtaggtggtttccctccctgtagaaatctggggagtgaggttctttccatcttgtggtgccatcattctccaggacaaagattcttacctacttttgtgtcctggtttcctttggcagcctggtgaagcctatggacctcatttcagaatatttttaaatacataaaatcccagcctgggcaatatagtgaaacccccatctgtacaaaaattagcc

SEQ ID NO: 76 - DNA, 601 bp, Human
ggcctgggctcagtgctataacaccacctggagtgagtggagccccagcaccaagtggcacaactgtgagtatcaagaggcctaagcaatggtaatctccactctccattcttcccctgtggccagacacttcccctggctgagtctctgggcttttatatcataggatgcctctaatggcaatcctgccattagatacacctgccgtggtgtatctgccaggtaggcaggctaggctgcagtaacacacaagcccacaatttccatggcttaacactataggaatatatttcttgctcaygtaacaagctaacgtgaatgttgctggtttgtaggtggtttccctccctgtagaaatctggggagtgaggttctttccatcttgtggtgccatcattctccaggacaaagattcttacctacttttgtgtcctggtttcctttggcagcctggtgaagcctatggacctcatttcagaatatttttaaatacataaaatcccagcctgggcaatatagtgaaacccccatctgtacaaaaattagccaggcatggtggcatgcacctgtagtcccaggtactgggaaggctgaggtggga

SEQ ID NO: 77 - DNA, 601 bp, Human
tgttgctggtttgtaggtggtttccctccctgtagaaatctggggagtgaggttctttccatcttgtggtgccatcattctccaggacaaagattcttacctacttttgtgtcctggtttcctttggcagcctggtgaagcctatggacctcatttcagaatatttttaaatacataaaatcccagcctgggcaatatagtgaaacccccatctgtacaaaaattagccaggcatggtggcatgcacctgtagtcccaggtactgggaaggctgaggtgggaggatcacttgagcccaggrgtttgaggctgcagtgagccgtgatcgtaccactttactcccacctgggtgacagagcaagagcccatctctaaaaataaataaatacaatgaaataaaataaaataaatagaactacagaggaaactaattgtattgaaatgcagttataaaacatttaaacacatttttaatctagagatatatgtgcttctttattaagatctataaataataagttctaggggtagctcacataaatactgtaatttcaaagtagataagcataaataatactttatgatactgaaattgtgatgt

SEQ ID NO: 78 - DNA, 601 bp, Human
tggtggcatgcacctgtagtcccaggtactgggaaggctgaggtgggaggatcacttgagcccaggagtttgaggctgcagtgagccgtgatcgtaccactttactcccacctgggtgacagagcaagagcccatctctaaaaataaataaatacaatgaaataaaataaaataaatagaactacagaggaaactaattgtattgaaatgcagttataaaacatttaaacacatttttaatctagagatatatgtgcttctttattaagatctataaataataagttctaggggtagctcrcataaatactgtaatttcaaagtagataagcataaataatactttatgatactgaaattgtgatgtgatatgagaatagctgtgagttttgttttgctggggacaggatcactgatgctgtcattactggggtctcttccctccattctttttttaaaattgtattttattttatttttaaaattttaaaataaatagagacagggtatcactatgttgcccaggctgcttttgacctcctgggctccagtgatcttcccatcttggcttcccaaagtgctgggattacaagtgggagcc

SEQ ID NO: 79 - DNA, 601 bp, Human
taatttcaaagtagataagcataaataatactttatgatactgaaattgtgatgtgatatgagaatagctgtgagttttgttttgctggggacaggatcactgatgctgtcattactggggtctcttccctccattctttttttaaaattgtattttattttatttttaaaattttaaaataaatagagacagggtatcactatgttgcccaggctgcttttgacctcctgggctccagtgatcttcccatcttggcttcccaaagtgctgggattacaagtgggagccagtgttcctggycccttcctccattcttaatggaaggagatgctaggtgtgagaggttagggaaagtaaagatgtaatttctttcccatccaagttctcagacccctgaattctacctgcagccatgttggtccatcaaccccaagtgaagaatccctgctctagggccccaccattgtctgtatccagccagcagaagaggcgtgattatggagatcacatctgcttcttgaaagcagacagcccggaagtgggccgcatcacttcctctcaaattctattggtgaaaatggtcacatgactacacatagc

SEQ ID NO: 80 - DNA, 601 bp, Human
gtgtgagaggttagggaaagtaaagatgtaatttctttcccatccaagttctcagacccctgaattctacctgcagccatgttggtccatcaaccccaagtgaagaatccctgctctagggccccaccattgtctgtatccagccagcagaagaggcgtgattatggagatcacatctgcttcttgaaagcagacagcccggaagtgggccgcatcacttcctctcaaattctattggtgaaaatggtcacatgactacacatagccacaaaggaggctgggaactttctcacttggaacstacatcccagaaacaactcttttcagtgaggtatcccacaggtctttcgcagtagaaatattgattatctcacataaaatgaagtcttacaaatggacctactgggttttgtacagcagccaagtgatatctcttcccttctgctgtcttcccttctgccatccttcacatggtggcattgtatccttagacttgccacccatgccctcaggttggccgttgcacactgtcttacataaagcaggaaggaaaggaaaggctgctacgagagagtgtaccttgtgcatctcttttttaatc

SEQ ID NO: 81 - DNA, 601 bp, Human
gaaagtaaagatgtaatttctttcccatccaagttctcagacccctgaattctacctgcagccatgttggtccatcaaccccaagtgaagaatccctgctctagggccccaccattgtctgtatccagccagcagaagaggcgtgattatggagatcacatctgcttcttgaaagcagacagcccggaagtgggccgcatcacttcctctcaaattctattggtgaaaatggtcacatgactacacatagccacaaaggaggctgggaactttctcacttggaacctacatcccagaaacractcttttcagtgaggtatcccacaggtctttcgcagtagaaatattgattatctcacataaaatgaagtcttacaaatggacctactgggttttgtacagcagccaagtgatatctcttcccttctgctgtcttcccttctgccatccttcacatggtggcattgtatccttagacttgccacccatgccctcaggttggccgttgcacactgtcttacataaagcaggaaggaaaggaaaggctgctacgagagagtgtaccttgtgcatctcttttttaatcaggaagcaaacatct

SEQ ID NO: 82 - DNA, 601 bp, Human
ttatggagatcacatctgcttcttgaaagcagacagcccggaagtgggccgcatcacttcctctcaaattctattggtgaaaatggtcacatgactacacatagccacaaaggaggctgggaactttctcacttggaacctacatcccagaaacaactcttttcagtgaggtatcccacaggtctttcgcagtagaaatattgattatctcacataaaatgaagtcttacaaatggacctactgggttttgtacagcagccaagtgatatctcttcccttctgctgtcttcccttctgccrtccttcacatggtggcattgtatccttagacttgccacccatgccctcaggttggccgttgcacactgtcttacataaagcaggaaggaaaggaaaggctgctacgagagagtgtaccttgtgcatctcttttttaatcaggaagcaaacatctttctagaagcttccctagcaaaattccccttacatctcattggccaagactgttacatgttacatggttactgttattacttgctcattgcaaggaagactgggaactcaaatgcctggaaaaaggaacaggataatcgtgattgg

SEQ ID NO: 83 - DNA, 601 bp, Human
tgttacatggttactgttattacttgctcattgcaaggaagactgggaactcaaatgcctggaaaaaggaacaggataatcgtgattggctcaagccttagggtgggcatggctccctgacaagggagagaggaaaaagctgttgagtgaagaagactgcttcagtttccccatctgtataatgggaggagtaagggctgtcgtgaaaactcaatgaaagaagattcttcaacgtggtaggtgcagtggcagctggcagtaccctgaccctgccaccgcacagccctctcagcattgctcrtcctgcactgtggatatcagttgagccacgtgtctcctgccctgggctgtgagctccataggcagggtctccatggctgtatctccagaacccagcacagaaccaggtgcttgggaaagttttgaattgattctcatctgccattggcatggggaagggaactagcttgtatgaaacagataacaatgtatgggaccctcattcattatttcagcaaatatttgctgagttcctcctacatggctagccctgtgctagacactggggaatcggcgatgaacaaagcagatagaaatcccc

SEQ ID NO: 84 - DNA, 601 bp, Human
ccatctgtataatgggaggagtaagggctgtcgtgaaaactcaatgaaagaagattcttcaacgtggtaggtgcagtggcagctggcagtaccctgaccctgccaccgcacagccctctcagcattgctcatcctgcactgtggatatcagttgagccacgtgtctcctgccctgggctgtgagctccataggcagggtctccatggctgtatctccagaacccagcacagaaccaggtgcttgggaaagttttgaattgattctcatctgccattggcatggggaagggaactagcttgyatgaaacagataacaatgtatgggaccctcattcattatttcagcaaatatttgctgagttcctcctacatggctagccctgtgctagacactggggaatcggcgatgaacaaagcagatagaaatccccactcttgtggagctgacattctggagggagagacaaaaagcaaacatataaagaaagaaagaaatcacatggatctggatgacagtgagtgctgggaagaaaataaaagcagaggaaggggatggagcgatgggcagggggcaacggtagggagggtgtcggggaaaact

SEQ ID NO: 85 - DNA, 601 bp, Human
atggctgtatctccagaacccagcacagaaccaggtgcttgggaaagttttgaattgattctcatctgccattggcatggggaagggaactagcttgtatgaaacagataacaatgtatgggaccctcattcattatttcagcaaatatttgctgagttcctcctacatggctagccctgtgctagacactggggaatcggcgatgaacaaagcagatagaaatccccactcttgtggagctgacattctggagggagagacaaaaagcaaacatataaagaaagaaagaaatcacatggrtctggatgacagtgagtgctgggaagaaaataaaagcagaggaaggggatggagcgatgggcagggggcaacggtagggagggtgtcggggaaaactttttggagaatgtgacgatgaaagtgaacaaggagaagtcaaccgtgttgagatgatggcagctaatgatgtggacaggccactctgttctgagtgcattatctattgattcatcatgtcatcctcgcaacagccctgcacgatcaattctgtcattaaccccatagtacagatgaggatgcggaggcacagagaagataagg

SEQ ID NO: 86 - DNA, 601 bp, Human
atctgccattggcatggggaagggaactagcttgtatgaaacagataacaatgtatgggaccctcattcattatttcagcaaatatttgctgagttcctcctacatggctagccctgtgctagacactggggaatcggcgatgaacaaagcagatagaaatccccactcttgtggagctgacattctggagggagagacaaaaagcaaacatataaagaaagaaagaaatcacatggatctggatgacagtgagtgctgggaagaaaataaaagcagaggaaggggatggagcgatgggcrgggggcaacggtagggagggtgtcggggaaaactttttggagaatgtgacgatgaaagtgaacaaggagaagtcaaccgtgttgagatgatggcagctaatgatgtggacaggccactctgttctgagtgcattatctattgattcatcatgtcatcctcgcaacagccctgcacgatcaattctgtcattaaccccatagtacagatgaggatgcggaggcacagagaagataagggacttgtcctgtgtcacacagcaaggagccatccggctcctaagttggtgcatttgacttctg

SEQ ID NO: 87 - DNA, 601 bp, Human
tgttctgagtgcattatctattgattcatcatgtcatcctcgcaacagccctgcacgatcaattctgtcattaaccccatagtacagatgaggatgcggaggcacagagaagataagggacttgtcctgtgtcacacagcaaggagccatccggctcctaagttggtgcatttgacttctgtgcttccggaaagaaagagcagcaagtttaagatctggaggtggcactgagctttggaggagcagggggcaatgaggtggccggtgtgacgaggactcaatgtgcaagagggagagtggyggggagatgaggtggaggggtggtcggcggtcagatcgtggagggtctcggacgagggtcctgaccctgggtctccagtcctgggaagtggagcccaggctgtaccatggctgacctcagctcatggcttcccctcccacttccagcctacagggagcccttcgagcagcacctcctgctgggcgtcagcgtttcctgcattgtcatcctggccgtctgcctgttgtgctatgtcagcatcaccaagtgagtcctgggcccagtgctgccgagcagtccctctggagtgcagggtggcag

SEQ ID NO: 88 - DNA, 601 bp, Human
acgagggtcctgaccctgggtctccagtcctgggaagtggagcccaggctgtaccatggctgacctcagctcatggcttcccctcccacttccagcctacagggagcccttcgagcagcacctcctgctgggcgtcagcgtttcctgcattgtcatcctggccgtctgcctgttgtgctatgtcagcatcaccaagtgagtcctgggcccagtgctgccgagcagtccctctggagtgcagggtggcagggacttgcccctctagtctgcccctttgcagtcctctcagtcaataatacgyatttactgagcagctactacacaccttgagagtagagctgagaacatatcgacaaggaccccacttttttctttttttcttttttttttttttttgagacggagtctcactctgtcacccaggctggagtatagtggcacaatcttgcctaacagtaacctccgcctcccgggttcaagcaattcttctgcctcagcctccagagtagctgggattacaggcgcatgccactatgcccggctaattttttgtatttttggtagagatggggtttcaccatgttggtcaggctggtctcga

SEQ ID NO: 89 - DNA, 601 bp, Human
cccctcccacttccagcctacagggagcccttcgagcagcacctcctgctgggcgtcagcgtttcctgcattgtcatcctggccgtctgcctgttgtgctatgtcagcatcaccaagtgagtcctgggcccagtgctgccgagcagtccctctggagtgcagggtggcagggacttgcccctctagtctgcccctttgcagtcctctcagtcaataatacgtatttactgagcagctactacacaccttgagagtagagctgagaacatatcgacaaggaccccacttttttctttttttyttttttttttttttttgagacggagtctcactctgtcacccaggctggagtatagtggcacaatcttgcctaacagtaacctccgcctcccgggttcaagcaattcttctgcctcagcctccagagtagctgggattacaggcgcatgccactatgcccggctaattttttgtatttttggtagagatggggtttcaccatgttggtcaggctggtctcgaactcctgacctcatgatctgcctgcctcagcctcccaaagtgctgggattacaggtgtgagccactgcacccaaccagg

SEQ ID NO: 90 - DNA, 601 bp, Human
cctcagcctccagagtagctgggattacaggcgcatgccactatgcccggctaattttttgtatttttggtagagatggggtttcaccatgttggtcaggctggtctcgaactcctgacctcatgatctgcctgcctcagcctcccaaagtgctgggattacaggtgtgagccactgcacccaaccaggactccacatttctaaaaccggcatcctactggggagactgaaaatacatatcaatcacaaacaggtggttttccatagtgacccactctctgaatgcactagaccagggtgsaggccagagatcttctggggtgctttttgcaagggggaccaggataaggctctccaaggagggaaaatttgaggggggccctgactggggagaatgagctggccagggataagcaagatggagtcatcccacatccccttacaacactgggtgcctgggcaactgggggcatttgggggcatgtggtaggagccagaggaatttgcgacgattgccctgatggagtcaggagacctgggtttgaatcctggccttggagcttggtagctggcggccgacaagttgctgaaacccctgagc

SEQ ID NO: 91 - DNA, 601 bp, Human
aaagtgctgggattacaggtgtgagccactgcacccaaccaggactccacatttctaaaaccggcatcctactggggagactgaaaatacatatcaatcacaaacaggtggttttccatagtgacccactctctgaatgcactagaccagggtggaggccagagatcttctggggtgctttttgcaagggggaccaggataaggctctccaaggagggaaaatttgaggggggccctgactggggagaatgagctggccagggataagcaagatggagtcatcccacatccccttacaacrctgggtgcctgggcaactgggggcatttgggggcatgtggtaggagccagaggaatttgcgacgattgccctgatggagtcaggagacctgggtttgaatcctggccttggagcttggtagctggcggccgacaagttgctgaaacccctgagcctggggttcctgctttgcagagtgacagtgatggtgagaacatatttcatcagccagaagaggccaaatcacagtaaaggctgagggaggagatgagtggcgagtggctgggaggtggtggaaggagcctcgtttccagagagctc

SEQ ID NO: 92 - DNA, 601 bp, Human
actgatcgccttgctctgagcctcagtttccccatcacctgtacctcttcccactccccatcactatatcccagcatgccagcctctttgctgttctttgtctttggtttcttgttttgttctgttttttagacagggtctcactctgttagccaggctgaagtgcagtggcgcggttacggctcactgcagcctccaattcctgggctaaagagatcctcccatttcaacttccagagcagctgggacaacaggcgcttgccaccacacctggctaattttcttattttaatttaatttwattttattttttgggacagagtggagtctcaaaaaccaagctagagtgcagtggtgcgatctcgactcactgcaatctctgcctcccgggttcaagcgattctcctgccttagcctcccgactagctgggattacaggcgtgtgccacgacacccagctaatttttgtatttttagtagagatggggtttcaccatgttggccaggatggtcttgaactcctgacctcaagtgatccacccacctcgttctcccaaggtgctgggtacaggcatgagccactgtgcctggccaattttct

SEQ ID NO: 93 - DNA, 601 bp, Human
cctcttcccactccccatcactatatcccagcatgccagcctctttgctgttctttgtctttggtttcttgttttgttctgttttttagacagggtctcactctgttagccaggctgaagtgcagtggcgcggttacggctcactgcagcctccaattcctgggctaaagagatcctcccatttcaacttccagagcagctgggacaacaggcgcttgccaccacacctggctaattttcttattttaatttaattttattttattttttgggacagagtggagtctcaaaaaccaagctrgagtgcagtggtgcgatctcgactcactgcaatctctgcctcccgggttcaagcgattctcctgccttagcctcccgactagctgggattacaggcgtgtgccacgacacccagctaatttttgtatttttagtagagatggggtttcaccatgttggccaggatggtcttgaactcctgacctcaagtgatccacccacctcgttctcccaaggtgctgggtacaggcatgagccactgtgcctggccaattttcttacattttgtagagactggctgtcacttatgtagcccaggctg

SEQ ID NO: 94 - DNA, 601 bp, Human
ggttcaagcgattctcctgcctcagcctcctgagtagctgggattgcaggcgcctgccaccatgcctggctaagttttgcatttttagtagagacggtgtttcaccatattggccaggctggtctcgaacttctgacctcaggtgatacacctgccttggcctcccaaagtgctgggattacaggcgtgagccgccatgcctggcctcatataagcatttctgtctccatttatcatccatctttccctcttgaaggtcagtttcaccaaggcaggcatctttgtctcgttcactgttgtrgcctcagggccaggcacagtgagtcaaacatagaaggtgctcaataaatatgtgtttatttattgaaaccatgggcagaggctaattcagaagcggtctgaggaccttacctcccagtgatgatgcaccatggccccaggcaggccaggaagagagaagggttgtgtttctccgtaggtcccccagcttcccaggccatcccaggccattccctggtcatttgccctcagctgctctgaaaaagggattgttgaggggaacctagaatcctctctctgcagtttgagtctttcctaatcc

SEQ ID NO: 95 - DNA, 601 bp, Human
agaaagggggattataggtcctgtctagaagagaaggtctgagggtccttgcttttccagggactctggaatctagtggtgttggctttgaatcctgactctgccactcactggcagtgtggacttgagcaagttgcttaattctctgagcctcagtttcctcttgtgggttataacagtgtttacctggtaggacagatattggaatttattgagacaatacatataaagtgcatattccagcctcttgcaaataccaagtgccatttatgtatcagttagtgtttgctgtgtaacaaaygaccccgaaatgtagagggttacaacaactttatttagcttatgcttctgcaggctggcatttggggctgggctcagcagtgagggtggcgggggaggctgggctgggctgggctgggcagatctgaattgagctgacccgtccccgtagcctccctccgtgtctgacagttggctttttttttttttttctttttctgagacggagttttgctcttattgcccaggagtgcaatggcgtgatcttggctcactgcaacctctgcctcctgggttcaagcaattttcttgcctcagcctc

SEQ ID NO: 96 - DNA, 601 bp, Human
ccagcctcttgcaaataccaagtgccatttatgtatcagttagtgtttgctgtgtaacaaatgaccccgaaatgtagagggttacaacaactttatttagcttatgcttctgcaggctggcatttggggctgggctcagcagtgagggtggcgggggaggctgggctgggctgggctgggcagatctgaattgagctgacccgtccccgtagcctccctccgtgtctgacagttggctttttttttttttttctttttctgagacggagttttgctcttattgcccaggagtgcaatggcrtgatcttggctcactgcaacctctgcctcctgggttcaagcaattttcttgcctcagcctcccaagtagctgggattacaggcatgtgccaccacgccaggctaattttgtatttttaatagagatggggtttcttcatgttggtcaggctggtctggaactcctaatatcagatgatccacccacctcagcctcccaaagtgctgggattacaggcgtgagccactgcacccagcctagttggctgacttttacctgggacagtgcaggtgcctgagccatgtgcctctcactctccag

SEQ ID NO: 97 - DNA, 601 bp, Human
ttgcaggtatatctttcaactatattttcaagtatatcctttctactacacttattggatattcttgttctacttttttcacagatcactttgttgtaataatttgggctaattcagaagttggaaagtaacaccaaagttaaatgcattttgttaaagagattattaagattatagaaagcaacaagcaacttgttaatagaacaaaatatacaattcaatttacctttactctttatggtgtagggaatgaagaactgtgtcttggtgttgggtagtgggccttttatgcctgtgggcrtttggtatcgttcagcgtaaaacactccatgaaccaagttcaaggatactagcagcaaaaagggtatttgtggcagcatattctcagatggattctgaaaaacagaaaagaataactttatacagcattgttattaacctatttttttattctcatgtttcacagatgagttctttatacagttatctacttttttaacctatcctatatatttttaatatgtgccataaataaatgagagatcattttttagttatgtgaatatatgtcttagttatttttggaagctatactcaggta

SEQ ID NO: 98 - DNA, 601 bp, Human
aagcacagggtacagatgtttctgagatttggaaaacatttggtgtatataaatgcagagcgaatcattaaaatagatatgccgaaataggaaaataattgtttcagatttagatttttttttactaattagagttatatttcaatttgaaaacattgattaatataaatacatagagctttccccatggattttcagaaaatgacatcaggaaaaagactgtgagaaaaatttatgtaaaagatttccgtatattaaatatttcattgattgtagtgtacatacatgattatattatgtmtaagtggatattgatatattgcaaatagaggaataaataaggaattttttaatgggttggaggaataaaatagtggattttttaaaatgccaactatgttagattgagctttgctttagaatctgattataagggtcatgttcacactaaaaataattgtcttagtctgattggaaatctgttttactattaaaaaggagaaacaagtcaatggaaatgagtgcattgggcgtcatccgagactggaactccagtgacagggcgaactttgtcacttggaatgttgtcctaatgggtctc

SEQ ID NO: 99 - DNA, 601 bp, Human
ttttgggaaaatcatgtacagaaaaggcagaaaaagacagtgcagaataagtgagaaaatgtttaagaactataaaaattttccctcccaaagctaccctgtcagacataaaagagaaacagaattaattctgatttacatctgccatgcctctgctgaacacaggttagattttggttgatttacttttacctcagaatatactctgagctcttatactctccattattgacttaaaattgaaacaaagaactagagaattagacataataggtgaggtacataaaatagtattaaagtwcttacctaaatacaaatatatagtgtttgatttcatagagctgtgagttcacttgacctgataaactaaacttaaactaaaaatcatagtgcctgtgatgtgaaaaatgcggctgggccacaagtatggggaaagcacagggtacagatgtttctgagatttggaaaacatttggtgtatataaatgcagagcgaatcattaaaatagatatgccgaaataggaaaataattgtttcagatttagatttttttttactaattagagttatatttcaatttgaaaacattgattaatataa

SEQ ID NO: 100 - DNA, 601 bp, Human
atatattgggttaaaaaaagcagaggtgctgggcacagtggctcatgcctataacccctacactttgggaggccaaggcaggaggattgcttgagcccaggagtttgagaccagccatagtaagacccccatctctacaaaaaaatttaaaaattagccaggtgtctgtggtcccagctactcaggaggcctaggttttgggcccgagaggttgaggctgcagtgagccttgatcacaccattgcactccagcctgggcaacagggcaaaaccctgtctcaaacagacaaacaaacaaacraaaggcagaggtaggttaagctatttattaatggtcttctactggtatagatataagctagaaataacattcaagtgtttttacttttactacagttatctggccactttgggactcattatactgaattagtttcacagaggaggtaaaatctgttgtttatgattacatattaactctaccattttaccttcagcattgctgtagtatgtcatatctgaaggcaattagcacaagtgacttgaagaattgtagttttgatgacttatatgtattttataaaaggcaggcagagttttt

SEQ ID NO: 101 - DNA, 601 bp, Human
tactggtgtgtgctgccatgcctggctaattttttatttatagtttttaaagacagggtctcactatgttgcccaggctagttttgaactcctggcttctagtgatcctcctgccttggtctcttacttaaagcactgggattacaggtgtgagccactggctgctcacatgttttttataatagtacttaataattttatgtctgaaaatattatataatgttattttgcccatttaaaaactttaaaaaatgctaacaaactgtgtactctgtaacttgtcttttttactcaacactaygtttttgagaatttttcttgttgatctgtgtagttccattttaactgttatatcttactatgtttcattatgcaacagttggttcaatccattctcttgttaatggaaatttagtttgtttctaatttttgccagtaggaacagtgttgcaatgcatattcttaaacatgtctgtacacatctgagggtttcatttatttgtgacaaaacttgccaggtcatagtgtttatgcaccttcaactagatattgtcgttgtcaaagtttttttccaaaaggattttaccaatttatacatgaa

SEQ ID NO: 102 - DNA, 601 bp, Human
cctgcctcaggctcctgagtagctggggttacaggcatgcaccaccatgcctagctaattttgtatttttagtagagacggggtttctccatcttggtcaggctgatctcgaactcctgacctcagataatctgcctgcctcggcctcccaaagtgctgagattgcaggcgtgagccaccgcacctggccggcagacagtttctttttttctttttgagacagagtcttgctctgtcgcccaggctggagtgcagtggtgcaatcttggctcactgaaacctctgcctcctgggttcaagygattctcctgcctcagcctcccgagtagctggcactacaggcgtgccaccacacccagctaattttttgtattttttttagtagagacgaggtttcaccgtgttagccaggatggtcttgatctcctgacctcatgatccacctgcctcggtctcccaaagtgctgggattacatacagtttctttaagcaagccttctcttttccttcctcccagttcttggtactctttcactttcatatatttgcaaatgtaaaattgtgttttaggtgtatatttttaatccatgtataccagtaa

SEQ ID NO: 103 - DNA, 601 bp, Human
gataatctgcctgcctcggcctcccaaagtgctgagattgcaggcgtgagccaccgcacctggccggcagacagtttctttttttctttttgagacagagtcttgctctgtcgcccaggctggagtgcagtggtgcaatcttggctcactgaaacctctgcctcctgggttcaagcgattctcctgcctcagcctcccgagtagctggcactacaggcgtgccaccacacccagctaattttttgtattttttttagtagagacgaggtttcaccgtgttagccaggatggtcttgatctyctgacctcatgatccacctgcctcggtctcccaaagtgctgggattacatacagtttctttaagcaagccttctcttttccttcctcccagttcttggtactctttcactttcatatatttgcaaatgtaaaattgtgttttaggtgtatatttttaatccatgtataccagtaacttaaaaaaaaatttttttttttttaagggagagcataatggagctcttgtgatacggtgctcttagtggaagtttggctatcaattccatcacctgtatttcacatattttattaatgaagttc

SEQ ID NO: 104 - DNA, 601 bp, Human
gtattcatttggctgggaggtagaaagcctactaaccaactttttttcatgaacaatatttttaaagtccaagatttttaatacctacattagggaaattctagaattaaattcttacaatgtggactgcatatgaggcttttagtgacagggaatttgttgaaggctatctgtgggttgtattttggtataacatttcctaattttatttgtggtatgttcatttgatatcatttggtaatacctgaaaacaggaactgattttactgtgttgctttttcatcatttctagctgaaatgyacagagacctggagccttaacagtctggttaaacacctcttaggtaaacagctcctgaaagacaagtctatccgctgtagcaattggagtaaatttcctctcactgaggaccagaaactgtatgcagccactgatgcttatgtacgtgcttaaagatctttagaaattgtgatgtgttttaaaaacattattataaatgactttagaaaaattttattatagtagtggcagaaactctaccaaaatattttatatcaatttggcattgaaaaatgcttaggaagacatttagtgaaacta

SEQ ID NO: 105 - DNA, 601 bp, Human
ggtatgttaagatccataaataaaatgtgaattcactcttttgtgaggtttatctccaaaaaaggcaatattcacatatttgcaaagcatttagtactataacttcttgaatgtctgagcagtcctgacattagggtgggatccatcagggcccaagatgagtgtttcatctttgttacttgtggcaaagcagcccttacttcttttactttgtagcattgctatgtatttggcttctagagttggggctttgtggctttcttattgcagtgacacaaccagctttctcctagtctggagrttatacatccttgctataagtatttaaaatgctttctatataatgctttaaaacatgtaagatggcttatccccaagatggtagctaataaacactaagtgataaagtaggtaaagatctatttattcatttattaaatattgttggtcattttacagtgctttctaacatactgatttacatttctaattttcttctgtcatttttctccaaaaataatggtcatgtcatccaacctcagtgctgtttttagaggtcttgataagccagtgagagcagaaggagccacgtagtagagtg

SEQ ID NO: 106 - DNA, 601 bp, Human
aacaaggtgctgtagttgacacaccgagaggcatctgacacattgggggaaatattctagaatatttcctggagaaagtgcaggtaaaagccagacctgaaacctgagcaagagttagctaaggccaggtgcagtggctcacgcctgtaatcctagcactttgggaggccgaggtgggtggatcacctgaggtcaggagtttgagaccagcctggccaaaatggtgaaacaccatctctactaaaaatacaaaaaattagctgagtgtggtgacgggcacctgtaatcccagcttcttggraggctgaggcaggagaatcgctttaatctgggaggtggaggttgtagtgagctgagattgcaccattgcactccagcctgcacaagagcgagactctgtctcagaaaaaaaaaaaaaaaaaagttagctagctgaagagtataggaaagaatgggtacaggaaattacaggtgccaagttacagaggtgagagaaattatggtatctataggtaattgaaagtaattcagtatagtgaacattgaatagggctgggcggatgaaggcaaagcagaaaaaggaaagcagatgggccatggt

SEQ ID NO: 107 - DNA, 601 bp, Human
gagcaagagttagctaaggccaggtgcagtggctcacgcctgtaatcctagcactttgggaggccgaggtgggtggatcacctgaggtcaggagtttgagaccagcctggccaaaatggtgaaacaccatctctactaaaaatacaaaaaattagctgagtgtggtgacgggcacctgtaatcccagcttcttgggaggctgaggcaggagaatcgctttaatctgggaggtggaggttgtagtgagctgagattgcaccattgcactccagcctgcacaagagcgagactctgtctcagaaaaaaaaaaaaaaaaaagttagctagctgaagagtataggaaagaatgggtacaggaaattacaggtgccaagttacagaggtgagagaaattatggtatctataggtaattgaaagtaattcagtatagtgaacattgaatagggctgggcggatgaaggcaaagcagaaaaaggaaagcagatgggccatggtaaggagtttatatctcctcccaagagcaatcgaagtgactgagagttttaaacacagcagtgaagtgaattacattaaaaaaataagaacttgggctctagaata

SEQ ID NO: 108 - DNA, 601 bp, Human
agcttcttgggaggctgaggcaggagaatcgctttaatctgggaggtggaggttgtagtgagctgagattgcaccattgcactccagcctgcacaagagcgagactctgtctcagaaaaaaaaaaaaaaaaaagttagctagctgaagagtataggaaagaatgggtacaggaaattacaggtgccaagttacagaggtgagagaaattatggtatctataggtaattgaaagtaattcagtatagtgaacattgaatagggctgggcggatgaaggcaaagcagaaaaaggaaagcagawgggccatggtaaggagtttatatctcctcccaagagcaatcgaagtgactgagagttttaaacacagcagtgaagtgaattacattaaaaaaataagaacttgggctctagaataaaaaacggatataggaggaaggcaggagtcacagtaggaatatcttttgggaggctgtgacaataatccaagtgagaagtaatggcaacttgagtcggttaattgtgttgagaatggagagaagttgacaggttcaaaattcatttttcttctttttttgagtctcactctgtcacccaggctgg

SEQ ID NO: 109 - DNA, 601 bp, Human
cttgagtcggttaattgtgttgagaatggagagaagttgacaggttcaaaattcatttttcttctttttttgagtctcactctgtcacccaggctggagtgcagtgatgcgatcttggcttaccgcagcttccacctcctgggttcaagtgattatcctgcctcagcctcctgagtaactgggattacaggtgcctgccaccacgcccagctaatttttgtgtgtttagtggagatgtggtttcgccatgttggccaggctggtctcgaactcctggtctcaagtcttccgcccacctcakcctcccaaagtgctagaattataggcatgagctaccacacctgacctcaaaatacatttaatagagcaagcatgagccactatgcccagcctcaaaatacatttaataaaccaatggaatttgaggtaatgatgaaagacacatgtcaaggatcattcctgtgttgttggcataagcaacagggatgaaaagcattgaggaagagcaagattttgggatgcgttgtcacacagttgattttaggtatgttaagggagggagacctgtaagacagcaaagtggaggtggtgcaagaattag

SEQ ID NO: 110 - DNA, 601 bp, Human
tcccagcactttgggaggccaaggtgggcggatcccttaggccagaagttggagaccagcctggccaccattgcgaaacactgtctctactagaaatacaaaaaaaaaaaaaattagctggtcgtggtggcacatgcctgtagtcccagctactccgggggctagggaatgagaatagcttgaagccgggaggtggaggttgcagtgagccgagattgcgccactgcattccagcctgggtgacagagtgagactctgtctcaaaaaaaaaaaaaaggaagggcttacattttattttggwgctgactgggaatgaaggcaatgagggatgactgttggagaaggctgtgcttactaaacagtattattaagtagcagcatacatggtgttatactgacttctgattttgcaatagtacagacaggttcagattctcatttccaccttctccttctgcctaggtgaataactgctgggttatagtacagatgactgcagatcatttggaatttactttaaatgtaaacagtaaaaatttgaaagagagggaaagtgattgaggcaatttggggattgaataagaaggtctttttgttggaa

SEQ ID NO: 111 - DNA, 601 bp, Human
ggtctttttgttggaattcatttaaggaaagaaaatgaaaatttgatccctaatattatttaatgaagtggctaaatgaatatctctgctttgtggtttgaaaattaatattgattttttttccccctagaggaagaaatcctacttagcgacatgaacaaacagttgacttcaatctctgaggaagtgatggatctggctaagcatcttcctcatgctttcagtaaattggaaaacccacggaggttaaatattaccttttttttttttaacttaaatcaattctgtttatttttttatyacattttcctatatgtgaagaatactattcattaaggctgactcatagaaatttgcttgaatacacacacacagactgatgcataaatttgagaaatatctttccagttgttgaatagtgaatccaaaggtttaagccttttctgtctgctttgtaggatgttttatgaaacaaaggaatagaaattgtattcatattatacattttgaaattatatctatattatattttttgtcaaagcaaaataaattatacattaaggaaaatatttaagattcaaagttgtcattttctttctgt

SEQ ID NO: 112 - DNA, 601 bp, Human
gggtaagatttgtgatagattttgattgagatttaaaaccatgatatataaatttagcttttttgtcaaagtaatttgccaccctagaatttgtgttggtaatttttaatgcaacttggacaatttctgaaagatgtaactttcttttttttgagacgagtctcgctttgttgcccaggctggagtgcagtgacatgatctcaggtcactgcaagctccgcctcccgggttcacaccattatcctgcctcagcctcccgagtagctgggactaccggcgcccgccaccccacctggctaatttttttttttatttttagtagagacggggtttcaccgtgttagccaggatcgtctcgatctccggacctcgtgatctgcccgcctcagcctcccaaagtgctgggattacaggcgttagccaccgcgcccagcctgaaagatgaactttaaaatggggaaggatactagtaaagccatttcttactcatgtatacatttttccctccatgaaattagagcagccaccttttacatgacttttacatgcatttcagatttttgtactagcaattaaaatatctactggatgtaaatcacat

SEQ ID NO: 113 - DNA, 601 bp, Human
gacaatctgaaagagtggacaaaactataaaaattagaactaagaactcttaaaatagaacggtttgaagtttgttacagaagggagcagctttatgcttcagtggactctgaaggtattggcagtgtatagtactgcttagtcattgatttaaattcggtatatatctcttctattgctgtcatgtacttgacattctgctgggtgctaaggctgtctgcaggctactaatatgcataataacaatcctgaaaaagaaggaaaagtatactgtgccttactgaagaaggcaggacagcckttggtatttgttagagtaaatattagttatcttacataaagcatgttatattccctgatgtcagggcctgataaatgagcccttacactcttgatagtcaatctgtgccactgttgctgtgtttgtatgttacaccatttcctgtccatgtaacagttaaactgtatcacatatctgttcctactaaactatttgcatataattttaacatttgagtggctgtatataaagctaaaagttctttataagatttatagcatcttagaatgtttaaattagataacattagtgtgcttttag

SEQ ID NO: 114 - DNA, 601 bp, Human
ctgaagaaggcaggacagcctttggtatttgttagagtaaatattagttatcttacataaagcatgttatattccctgatgtcagggcctgataaatgagcccttacactcttgatagtcaatctgtgccactgttgctgtgtttgtatgttacaccatttcctgtccatgtaacagttaaactgtatcacatatctgttcctactaaactatttgcatataattttaacatttgagtggctgtatataaagctaaaagttctttataagatttatagcatcttagaatgtttaaattagrtaacattagtgtgcttttagtttttgaatttaattttgctcttgattttgtttgtgttaatgtagactttgtctacgtaagcttgagcccaactttggagtggtgttttcagtgatggaagtaactggaaataactcatgaaaccacttagtacttttgatagtttattcccatgaaggatcaaatttttacttgagtcattaatataaaaatttaaaagacatgtcagattttattaagcatggattttaaatatataaatattagaagacctaaacaaaatcgctaatgaaagagtaa

SEQ ID NO: 115 - DNA, 601 bp, Human
ggattcaagggattctcctgcctcagcctcctgagtagctgagattacaggcgcatgccaccaagcccagctaatttttgtatttttagtagagacagggttttgccatgttggccaggctggtctggaacttcagacctcaagtgattcacctgcctcagcctcccaaagtgctgggattacaggcatgaaccaccgtgcccgccccaaattttcttttaacttaaagtgttaatgtttgtttgttcccaatatttttatatatgtcaaggctttttcattatatacaggccagctcttkggagttctgcatagtgtttcttgtttaaaccacacctataatgtaccatctacaatttccaattctttaagacagagtgaaaaattaagacacctgaagcaatctgagtgcggagtcctaggcattatgattttccttgacacttttagggttcttttatcacagtttatcaaacaccttttttttttttaacaaaaaacaaatttacaaaatctttccatgtattcaacttagaatttaatgaaatagggtttttttttttttggtggtcatgtatcatcaactttctttacatttaat

SEQ ID NO: 116 - DNA, 601 bp, Human
acaaatttacaaaatctttccatgtattcaacttagaatttaatgaaatagggtttttttttttttggtggtcatgtatcatcaactttctttacatttaattaaattaatcaacaaaaaacatatagttgacataaacaaatttgggaccaagcactactgactcttagtaaacatacaagtcaactgttggtgcagaagtgccttgatgctagagagtagcctgcaagctgtaattatatatgggcattagggaatgaagaacagccttaatactattgatcttttaagtgaaggtcascttagaaagcttttacttgttaaaaagcttcacagtttgtccttgtagttaatgcaattgaagttgaattaatctttcttaattttttttttagggtttctatcttactaaaggatatttcagaaaatctatattcactgaggaggatgataattgggtctactaacattgagactgaactgaggcccagcaataatttaaacttattatcctttgaagattcaactactgggggagtacaacagaaacaaattagagaacatgaagttttaattcacgttgaagatgaaacatgggacc

SEQ ID NO: 117 - DNA, 601 bp, Human
tttgagatggaatctatctctgtcgcccaagctggagtgccgtggcgcagtcttggctcactacaacctctgcctccccggttcaagtgattctcctacctcagcctcccgagtcactgggattacaggtgcccgccaccacacccggctaatttttgtatttttagtagagaaagtgctgggattacaggtgtgagccactgcacctggccttggatttcgtgatttgactgacatcttttacaccaattattgccatttttttattgggtactaattattagtattgctttctttattygttaaataagaagtaaaagaacttttaaaaaataaaataactttttttcctagtacaaagcttattttcaattttttttattgcttaaattttgcaggttaattaaggctgtacttctttttcctacttcctgtttaaatatttggcattttttgagggttttctttctatggatttttgtgggggatcccatctcgttggacacttggttcctggagattgccaaattattgaaaagtttcctcatacccaaacattggcaatagactgaataaataacatctctgacattatttttca

SEQ ID NO: 118 - DNA, 601 bp, Human
ttggttctttgtttctttgttccattcttctctctctcccttttttatctatcatataaatatgtaaatatatattatatatccattagggaagaggaagttgtctaaagatatctagtatataggagctttgttctgcagaaaagaggatatgaagtcaattatattggaaattaatgcttaatactttttttaaagcatttatctcccaatgataatgaaaacgatacgtcctatgtaattgagagtgatgaagatttagaaatggagatgcttaaggtatgtttacaattataaaaayattacttcaagttctttccaaaggacatttaattaagtaaaatattaactaattctaaactaggttctaccacaatgaaattgctactaattatgtaacattagatttcacattttccaattcatgtttctttcatgtagtctataaataatgggttagaggtaatttactaattttaaatgtgctttccttgttccttcttattttttattttgaagacagggtctcactctatcacccaggctggagtgcagttgctccatctcggctcactgcaaccttcacctcctgggctcaagt

SEQ ID NO: 119 - DNA, 601 bp, Human
ttagtaagtgtttaatacatattagctaacagtaaaactagaacataaatactgaattgtattttgttattaattatccatttctctgagaagtactgttccaatagtacatttataggaaacttgtggacgtctacaaacgtatacattaaatctcttagaaggcaacctggatgcccatattagagaactctattttaaacatgcattctaagtatgtttgtggacttgaataaaataaaacaaacagaaacacttctttcttctgccttcaggcttgaaatgaacatacttttttttaaaaaaaaaccttcaaaatgaaaatattaaataaaagatttaataaaaagagaaagtaaaaactgtagtttaataaagtcttcctgtctcttcatagttaaaaaatgttatagatgaaacaattttgaaatattcttgaaatagataatctttatttaggggagaatgtcagatactgtcaagccaaaataaaaacaaataactttatttcatgtttgtaaaattccttttctaaaatgatttgaatcttttgttgttttgacaattccaaaacacatttattgtttgctcatagtttcag

SEQ ID NO: 120 - DNA, 601 bp, Human
ttgcttggttgcccaggctggtcttgaactcctggcgtcaggattgtttccagttttggattattacaaataaagctgagacacatataagtctttgtatggacatatggtttcattttattgatacatgtcaaggagtgggatgactggatcgtgtggtggatatatgtttaactttcttttttctgagataaaattagaaggcgatcctcctgccttggctttccaaagtgccgggattacaggcgtgaaccaccgcacctgatgcagttgttgttgttgttgttgttttaatatctgrttattattttattgtatttcattgaatatagcacagtttgtttttacattttcttattgatagacacctaggctatttttctggttttggactgttactaataaagctgctatacacatccttataaaaatcttttttgtgaacatgttttctttttttctaagcattttaaatcacctttattgaggtgtaattgacttacaataaattttatatgctgagaatgtataatttgataagttttgacacaggtatgcactcatgaaaccatcatcacaatccagataatgaacatattca

SEQ ID NO: 121 - DNA, 601 bp, Human
cattcatcagtgatggacatttgggttgtttcctttttggctgttatgaataatgatgctgtgaacatttgtgtaccaatttttttatgaacatacattttcaacgcttttgcatatatgcctaagagtggaattgctgggctatatgctaattttttaagaaactatgaagcttttgagagtgattgtatcatgggatattcccaccagcagtgtatgagaggtccagttcctccccatccttgctatcacttagtctggctgatctttaacttaagccattctaatagtatctcattgkatttttagtttgcttttccctaatgactaattatattgagcatttttcatacacttattggccatctgtatatcttctttgagggagtatctgttcaaatcttttgcctattttttcttagtgagttttgatagtcatttctatattctgaatataaattatttatttgatatatgctttgcaaacattttctcctagtttatggcttttcatactttccacacagttcttttgaagagcagcagtttttcattttgataaagtccagtttgtcgattcgttcttttagggattttgctt

SEQ ID NO: 122 - DNA, 601 bp, Human
ctccattaaaagctagtttgtcaaacctgtaactaaagctttttaaaaaatgaaagttttaaaagagaccatcattctgttttaacctatttaatttaaaatctgggctgaagtaggagtattgcttgaacccaggagttcgagaccagcctgggcaacacagtgagaccccatctctgaaaaaaaaaaatgagctgagcatggtacctgttacagtgctagttatgaaagaaagaaagagagagagagagaaggaaggaagggagaaaggaaggaaggggctgggagtggtggctcacasctgtaatcccagcactttgggaggccgaggcgggtggatcatgaggtcaggagatcgagaccatcctggcgaacatggtgaaaccctgtctctactaaaaatacaaaaagaaaaaattagccgggcatggtggtgggtgcctgtagtcccagctactggggagggtaaggcaggagaatggcatgaacccgggaggcagagcttgcagtgagccgagattgcgccactgcactttagcctaagaaaaggaaggaaggaaggaaggaaggaaggaaggaaaaatcagtcactcactcaggt

SEQ ID NO: 123 - DNA, 601 bp, Human
ctgggagtggtggctcacacctgtaatcccagcactttgggaggccgaggcgggtggatcatgaggtcaggagatcgagaccatcctggcgaacatggtgaaaccctgtctctactaaaaatacaaaaagaaaaaattagccgggcatggtggtgggtgcctgtagtcccagctactggggagggtaaggcaggagaatggcatgaacccgggaggcagagcttgcagtgagccgagattgcgccactgcactttagcctaagaaaaggaaggaaggaaggaaggaaggaaggaaggaaawatcagtcactcactcaggtttagtttcaaaagccaaaacagtgataatattgaattttttccagccactcagtagtacccagagaattttgatacaaataactgactttgaccccatgtttagtaggttttttttttgtttgtttgtttgttttttttttttgtctttcttctccacactctcttaggactgttgtagcttgtaatgttagtgaattgtaattgtttatttgcatgtctgtctcctcttttagaattgtgaactcctcaggtcatggattgtattttattagtcttttta

SEQ ID NO: 124 - DNA, 601 bp, Human
ttaaaataaatgcttcttgtccaatcatggtgtctcacacccataatcccagcactttgggaggcagacgttggagaatcacttgaggccaggagttcgagaccagcctgggcaacatggtgaatccctgtctctacaaaaaatacaaaaattagctgggcatggtggtgcatgcctgtagtcccagctatttgggaggctgaggtgggaggatcatttgagcccaggatgttggggctgcagtgagctgagatcacaccactgtactccaggctggatgacagagcaaggccccgtttcaaaaaaaaaaaaaaagcttctaccaatacaaacacaaaacaagcatagacaaatagagtttaaagaacatcattggtgttttcctctaaagggaatattgatgctaggccaagaaaatcctggagttattcttgaggaccttaaggaataattgaaatgtaggatttgctcctggctttcttgtcctatattcagaataaaacaagaatggatcgaatatattctgagtgttctggccattctagtgctctctgaagtgagtactcactgtgtttcacttccctttcatcctaaagaggaa

SEQ ID NO: 125 - DNA, 601 bp, Human
accagactaattgttaatctggtgccttgcattccccaaagtatttgtatctgtcgtttataagtttttatcaaggtttcagctaaaacaaataaatttgtttctggttttagctttaatttgaactgaaacagtcaaaactgagttttggggacttcacacaattcatttggatatttgattctccataatgttttaaattttcatgcacttaaatatatcattatttttgataggctttcttcctttagtcttttctttagaaggtagaaaggaagaattaaataagataaaaccaaaygggtctgaagcatgtataaagtatatatgtttgctcttttgttcttctttttctttagttcccactgggaatttgaaggtccaacaatcatctactgtccttctagaaaaatgacacaacaagttacaggtgaacttaggaaactgaatctatcctgtggaacataccatgcgggcatgagttttagcacaaggaaagacattcatcataggtttgtaagagatgaaattcaggtatgaggatcaatcatcattgctctccgttgctcatagtggaagtggatatttctcaaatgtttat

SEQ ID NO: 126 - DNA, 601 bp, Human
agtgtatacgatttacataattattactctgtaaatgctttttatgatctctgagccatgtagtatattatggctatttttctttcttatctatttgtatttttattgttattacctaaaaaaaaattttctatgtcttatcactaattcttccctaaaatttcccacaattgtgtaaacttacctcagtatattcatagatatgagacattctatcaattttaccctcttaaagatgcagagataatgcattatgtttcatcccaccatctttaatgagaagcttccatcttagattaayattagagaatgttaaaatactctgcaatcaggtaaggacgcttgaaacttcattataatgcaaaagttttctttaacacaataaatattttgaaccctttttgtgtcttgtattcataggagttcagatagaccactttatttactattttttatagagagtgaacagaaatcccatttctagtcaccagtccttaatctgtaaatcaggcagataatctgtaaatgattggttgaaatcacattgaattccactttgtgccagggacttaagttaacgaacaaattattcttacaaaaa

SEQ ID NO: 127 - DNA, 601 bp, Human
gccatgtagtatattatggctatttttctttcttatctatttgtatttttattgttattacctaaaaaaaaattttctatgtcttatcactaattcttccctaaaatttcccacaattgtgtaaacttacctcagtatattcatagatatgagacattctatcaattttaccctcttaaagatgcagagataatgcattatgtttcatcccaccatctttaatgagaagcttccatcttagattaatattagagaatgttaaaatactctgcaatcaggtaaggacgcttgaaacttcatyataatgcaaaagttttctttaacacaataaatattttgaaccctttttgtgtcttgtattcataggagttcagatagaccactttatttactattttttatagagagtgaacagaaatcccatttctagtcaccagtccttaatctgtaaatcaggcagataatctgtaaatgattggttgaaatcacattgaattccactttgtgccagggacttaagttaacgaacaaattattcttacaaaaaggtataaatgtaaggttttcattctgctaaatatgtttgtcaaactgtgttgtg

SEQ ID NO: 128 - DNA, 601 bp, Human
atttttattgttattacctaaaaaaaaattttctatgtcttatcactaattcttccctaaaatttcccacaattgtgtaaacttacctcagtatattcatagatatgagacattctatcaattttaccctcttaaagatgcagagataatgcattatgtttcatcccaccatctttaatgagaagcttccatcttagattaatattagagaatgttaaaatactctgcaatcaggtaaggacgcttgaaacttcattataatgcaaaagttttctttaacacaataaatattttgaacccyttttgtgtcttgtattcataggagttcagatagaccactttatttactattttttatagagagtgaacagaaatcccatttctagtcaccagtccttaatctgtaaatcaggcagataatctgtaaatgattggttgaaatcacattgaattccactttgtgccagggacttaagttaacgaacaaattattcttacaaaaaggtataaatgtaaggttttcattctgctaaatatgtttgtcaaactgtgttgtgatttgttctcagtgtgtcatagctaccatagcttttggaatggg

SEQ ID NO: 129 - DNA, 601 bp, Human
gtgtgtcatagctaccatagcttttggaatgggcattaataaagctgacattcgccaagtcattcattacggtgctcctaaggacatggaatcatattatcaggagattggtagagctggtcgtgatggacttcaaagttcttgtcacgtcctctgggctcctgcagacattaacttaaataggtaaaaaaaatttattgtttttactcttgcagatttctttctttctttccatataaacctcaaaagtgtttgaggctatttccagtatcccaagtaatttgtgagtgcatttaaagtaaaaaaaaaaaaaaagaaaaataaaacctccccaaatccagaggacatgtaagaagaacatttgtggtaagagttgccacttggagatgagctaatttcagcatgccttagttagtgtgaggaattaactaaatcaggacaatacttgggcctgtcacagagatcctatggaatactttcctaccattgtgcattaatgaacaggttcttttcctctcctcagatcctgtcaagttgcgatgtcttcagccatagttacttcaactaccactgattttgttactgattctttcttcccatg

SEQ ID NO: 130 - DNA, 601 bp, Human
aacagagaataatttgcagagtaatctcggtccggtagatctttcagtggatccaaatgattgccatgaatggtttagaatttttttaattttcaagttgtttttattctgtggaatactggacttatttttgtagtcccaaaagaaaaataaatatttatttatttgccgttaagagttgtagttttgttttctcaaatttgtcctgacactgacgagattagttaaatgtaggtcatctgaaccaaatacaaggaaggaaggacccagttctgaagagtgtgggcatttcttttcttgkttttttttttttttttttttttttctataggaggggaacgaggtgaactaaacaaacaaaataaagcaaaaaagaactgatttttatcccttgaggtagaaagaatgagattacagtggacccccttgtctgcattttcactttctatgttttagttactcacaaccacgtccaaaatgttaaatagaaaattccagaaataaacaatttataaattttaaatcagtggtggctttgagtactgtaatgaaattttgtgccatcccactcagtcggcctcgacttcccttagaatcatcc

SEQ ID NO: 131 - DNA, 601 bp, Human
acaaccacgtccaaaatgttaaatagaaaattccagaaataaacaatttataaattttaaatcagtggtggctttgagtactgtaatgaaattttgtgccatcccactcagtcggcctcgacttcccttagaatcatccctttgtccggtgcattcacgttgtatttactccctgtctgttagtcacttgttgcagtatcacagtgcttgtgttcaagtaacgcttattttacttaagaatgaccccaaagcacaagagtactgtgcctaatttataaattaaactttttcataggtatayacatataggaaaaaacataatacatacaggatttggttggtactattctgcggcttcaggcatccactggacgtcttggaatgtatcccttgtggataaggaggaactgtatatggttaacctaggagctagagtcaacagttggaagagactttggggataattacatggaagggcatggtgggtggtcgtttcagatgacaagaatgtttttgaataacggatcatttgtgtcttcagactttccagaactccttgagaattatgcagaggtatttaatcagtcagaaggttgaatag

SEQ ID NO: 132 - DNA, 601 bp, Human
gtaaaaattaataaattgtagaagcattgtttgaagccaaaaagtgtgtgacatgtaaattgaaatgaaaaaccttagagtttttgatactttttcaaagcagctaaagaattgatacttggacacaggaagaattttttttcaaaagcaatttttataaaatcagaaaaatgtttacctcttgttgggggcattgactggaaaggaatacaacagaactttctgagatgctagaaatgtttttttatcttgatggggtgtgggttttgtagataatgaaaaataaacagtaaaaaataaktaaaaaaaaaagtaagaaagttgccaatacagttttacatattcctgtgatgtttttaatcgacaggcaccttcttactgagatacgtaatgagaagtttcgattatacaaattaaagatgatggcaaagatggaaaaatatcttcattctagcagatgtaggagacagtatgtattatttattttatgccaatagtatggatttatggatgatgctcttttaagacaacaatttggctaaataattatcagtattttgaaaaaatattttgttgctgttacatgtgtgctgaattttta

SEQ ID NO: 133 - DNA, 601 bp, Human
ttgatgcataatattaatcatcacaaccaagaagacatcatcctaaatatatatatatatctacttaacaaaaagactgacagaactgaaaggagaaatagagaaatctacagttacatttggtgacttccagcatctctcaataatcaataaaactgacagaccaaaaaatcagtaagaagacagaagaaatgaacaggattatcagcatgctggatctcattgacctttttagaacattctacccaacaacagtagagtacacattcaagtgcagatgcagtattcatgaacatggatyatattcagagtcataaaacaaaccttaacaaatttaagaatcttgtatttgtatattttttgactagaatggaattaaactagaaaacaataacagaaagataacagaaaagtctctaaaccttagaaattaaataacacacttataaataaatccatgagtcaaagaggaagtctcaaggcaaatcagaaaatgttttgaactgaatgaaatgaaaatacaaaatgtgtgagatgcagctaatgcaatactgagaaggaaatttatagcattaaatacctatgtaataaaagaagaaag

SEQ ID NO: 134 - DNA, 601 bp, Human
tgcatgctgttttatttttttttatttttttgacatagggtcactacaggctgtcacacaggctggagagcagtggtatgatcatagctcactgtaacctcaaattcctgggctcaagcaattctcttgcctcacctcagcttcccaagtagctacaggcatgcactaccagacccagttaattaaaacaaatttttttttggtagagacagtctcagtatgttgcccaggctggttttcaaactccttgcctcaatcagtcctcctacttcagcctcctaaagtgctgggattataggcmtgagccatcacgcttgactaatgtttttgtaaataaagttttctcagaacacagccatgccttttgtttatgtgttatgtagggctgcctgagttaagtagttggctacaaagcctatcatggcctataaagcctgaaatacttactatctggtcctttatagaaagtgttttctgaccctgtactagactagcttgtctcaaaattcttcaatgaatttggaagttttctcaccacattttctgaccataatgcacttgagttagaagtaaataagcagataaacaacaaaatcctcat

SEQ ID NO: 135 - DNA, 601 bp, Human
agtaaataagcagataaacaacaaaatcctcatgcatttggaaattaaaaataacacttaaataattcatattcaaagaaaaaatcaaactggaaattaaaaaaaattttaaacctacagataactacattaatatgcattaacatttttagaacttagggatagttacaatgatatacattaaaactggtaagaggctgggtgcgttggctcacgcctgtaatcccagcactttgggaggccgaggctgggggatcacgaggtcaagagattgaaaccatcctggccaacatggtgaaaycccgtctctactaaaaatacaaaaatcagctgggcgtggtggcacgcgcctgtagtcccagctacttgggaggctgaggcaggagaatcgcttgaacctgggaggcggaggttgccgtgagccgagattgggccactgcactccagcctggcgacagagcgacactcttgtctcaaaaaaaaaacaaaaaaaaaaacaaaaaaaaaaactagtaagagggcccagtggctcacacctgtcattctagctctttgggagactgaggagagaggatcagttgaggccaggattcaagaccag

SEQ ID NO: 136 - DNA, 601 bp, Human
actggtaagaggctgggtgcgttggctcacgcctgtaatcccagcactttgggaggccgaggctgggggatcacgaggtcaagagattgaaaccatcctggccaacatggtgaaaccccgtctctactaaaaatacaaaaatcagctgggcgtggtggcacgcgcctgtagtcccagctacttgggaggctgaggcaggagaatcgcttgaacctgggaggcggaggttgccgtgagccgagattgggccactgcactccagcctggcgacagagcgacactcttgtctcaaaaaaaaaamaaaaaaaaaaacaaaaaaaaaaactagtaagagggcccagtggctcacacctgtcattctagctctttgggagactgaggagagaggatcagttgaggccaggattcaagaccagtctgggcaacataacgagaccgcatctctacaaaattttaataacaacaacaaaaaaactggtaagaggcaacattgaatagtactttgtgggagtttattagcttgaaatactcataatagaaaagaaaattaatcagctaagcatctcactaaagagattaggagaataaacctaagcatagt

SEQ ID NO: 137 - DNA, 601 bp, Human
ggtaagaggctgggtgcgttggctcacgcctgtaatcccagcactttgggaggccgaggctgggggatcacgaggtcaagagattgaaaccatcctggccaacatggtgaaaccccgtctctactaaaaatacaaaaatcagctgggcgtggtggcacgcgcctgtagtcccagctacttgggaggctgaggcaggagaatcgcttgaacctgggaggcggaggttgccgtgagccgagattgggccactgcactccagcctggcgacagagcgacactcttgtctcaaaaaaaaaacaamaaaaaaaacaaaaaaaaaaactagtaagagggcccagtggctcacacctgtcattctagctctttgggagactgaggagagaggatcagttgaggccaggattcaagaccagtctgggcaacataacgagaccgcatctctacaaaattttaataacaacaacaaaaaaactggtaagaggcaacattgaatagtactttgtgggagtttattagcttgaaatactcataatagaaaagaaaattaatcagctaagcatctcactaaagagattaggagaataaacctaagcatagtttt

SEQ ID NO: 138 - DNA, 601 bp, Human
taatcccagcactttgggaggccgaggctgggggatcacgaggtcaagagattgaaaccatcctggccaacatggtgaaaccccgtctctactaaaaatacaaaaatcagctgggcgtggtggcacgcgcctgtagtcccagctacttgggaggctgaggcaggagaatcgcttgaacctgggaggcggaggttgccgtgagccgagattgggccactgcactccagcctggcgacagagcgacactcttgtctcaaaaaaaaaacaaaaaaaaaaacaaaaaaaaaaactagtaagaggkcccagtggctcacacctgtcattctagctctttgggagactgaggagagaggatcagttgaggccaggattcaagaccagtctgggcaacataacgagaccgcatctctacaaaattttaataacaacaacaaaaaaactggtaagaggcaacattgaatagtactttgtgggagtttattagcttgaaatactcataatagaaaagaaaattaatcagctaagcatctcactaaagagattaggagaataaacctaagcatagtttttttcccccaaacattattatatctggaatatt

SEQ ID NO: 139 - DNA, 601 bp, Human
ccccgaatgagtgagcccctaaacaggaccaggagtggcagaagaaagaggcagcaactgagatgtgttttttctaagctgaaaggctttttttttttttttttgcaacacacctttaacactaaagtccaatatttatataattggtcaagtaagtggagctgttctagctataaatatggcaactctgcttgctcgtcctattattgacattattcctttctgtggtctgaggtgcctcccatgaaacttgcttctaggacactaggattgagaaccatcagcgtaacatatctgttaygctacaatagtttattttcatattttagctactttacatactcgggtataatgaactttattcatagcttctgaagcagttggcacatttgagatattttttacttggctaattgttatgctaaatcttttgatttctaaagatacatgcctttgctaagctttcttcaaatgttattatttttatttagattggatcattgctattccatggatgactcagaggatacatcctgggactttggtccacaagcatttaagcttttgtctgctgtggacatcttaggcgaaaaatttggaa

SEQ ID NO: 140 - DNA, 601 bp, Human
gctaaatcttttgatttctaaagatacatgcctttgctaagctttcttcaaatgttattatttttatttagattggatcattgctattccatggatgactcagaggatacatcctgggactttggtccacaagcatttaagcttttgtctgctgtggacatcttaggcgaaaaatttggaattgggcttccaattttatttctccgaggatctgtaagtatatatctgtgaattcccttcatagatcttcttttacttctattacacttttcttcagaggtttgcagtattatgattgtarctttgacttcagatgggtgactaggaactcatagagtcttactaagttccagttaaacactacattcattactttggataaaacccgtgtgtatggcatcttctgctgttttcatgttcaagccgatgttcagctctgcagctcagtctggaagcattgtgttaatttatcacattgcatttgggtgaatccctagactagtcttgcttaggataattaggaaaagttaactttcattgtatcaagggacaggtagaacaaaattgtccttttgtccaggaaactattaaattcttcaag

SEQ ID NO: 141 - DNA, 601 bp, Human
aaaaaaagttaaagtgtttttaacaatagctgtgggctttttgtagtttcagaacttaggagttgcccaggctggaatgcagtggtgtgatcatagcttgatgcagccttgaactcctgggttcaagcaatcctcccacctcagcctccagagtagctgggaccacaggtgccaccccacccagctattttttttattttttaatttttttgtaggtatggggtctccccatgttgccctgcctgtctcaaactccagggctctcaggtgatacccaccacccttggcctcccaaagcacygagagtcactgtgccaggctgagtttaaaatttcttgagttggagtttatggctattttttccactagttattaaacatgtatttttgtataaggcactgtattacattttgtggggggattcaaagctaaattagatgagacgcatcatctattatggaagatgttacttaagaagaaatgagtgtaatgtagcagagaattagataagggacgtatgaatacatataaatgctgttgaagttctgaagagagagagtgtttagagaaattagaggagtctttgtgaaggtatcactag

SEQ ID NO: 142 - DNA, 601 bp, Human
ccaaagcaccgagagtcactgtgccaggctgagtttaaaatttcttgagttggagtttatggctattttttccactagttattaaacatgtatttttgtataaggcactgtattacattttgtggggggattcaaagctaaattagatgagacgcatcatctattatggaagatgttacttaagaagaaatgagtgtaatgtagcagagaattagataagggacgtatgaatacatataaatgctgttgaagttctgaagagagagagtgtttagagaaattagaggagtctttgtgaagktatcactagaacttcctatttttgtggaatatatagtagattttggtgtgatactgtggatttggacattcactcagagaaggaatgagggaagaatggtggagaagaatggcattcacagtacaaaaagcaactgtgacttttaaagaagttaatatggagaagtggcaagtcttttcttctctcttctcttctcttctcttctctcttctttttcttttttctttttttctctgtcagataccgttgtaaagactttgcttttaccggaaactgatacgttgggtcatgtaccctggc

SEQ ID NO: 143 - DNA, 601 bp, Human
caaaatagttcaccaagggagctgtggcctcttctgtgatcaagaagccatctgtcaacttgggaagcttccactatagcacctaaccccagactacattgagtaggaagctgtaataatcaggaagcttctacctttgcatgctctgcaaaccaacgtgaacctgctgtaatttgtaaccacaaaatggatgcctgttgatacttacgaagctcatcattgtatgctgggttctttgctaatactttcttataaaaattaaatacctccacaatcatgcatgctagcagaaacagcagasgagtagccttagcctcacttcctgcttatacctgtcatgcaaatatacagaacccagaaccctagctgaaagggagtttgagaactagtatttgtattgtcccagattctgcagtggaagaattcatagtggatggaagttagaatgacccttgaattacaatcggccacattcatcacaaatacattaaataagagtaatttgccataaagctctatgtttgtatacttctttgttttttttttttttttttttttttttttttgagacagggtctcactctgttgctcagtctgtagt

SEQ ID NO: 144 - DNA, 601 bp, Human
agaagccatctgtcaacttgggaagcttccactatagcacctaaccccagactacattgagtaggaagctgtaataatcaggaagcttctacctttgcatgctctgcaaaccaacgtgaacctgctgtaatttgtaaccacaaaatggatgcctgttgatacttacgaagctcatcattgtatgctgggttctttgctaatactttcttataaaaattaaatacctccacaatcatgcatgctagcagaaacagcagacgagtagccttagcctcacttcctgcttatacctgtcatgcaratatacagaacccagaaccctagctgaaagggagtttgagaactagtatttgtattgtcccagattctgcagtggaagaattcatagtggatggaagttagaatgacccttgaattacaatcggccacattcatcacaaatacattaaataagagtaatttgccataaagctctatgtttgtatacttctttgttttttttttttttttttttttttttttttgagacagggtctcactctgttgctcagtctgtagtgcagtggtgtcatcatagctcactgcagtcttgatctcctga

SEQ ID NO: 145 - DNA, 601 bp, Human
gagaacaacagaattgcatatgacagactagctttcttaatatttctagaacttgatggctgtgaagagcgtcccgtaggaattctcccttcacttaggaaaacatacctcaaaaccatcagctgtttagcatgcacctgcttttcctggtatatctcagtgaagcagctaaattgtaaatgattaagtaaactttgcagtgtatcatgtgcaaaagcacagtaaaaacaaaaatgcattggaagctgtgagttgttgcactgcactcatggatgaatagctgttggttcgcattgcgttkttttgttttgttttgttttgtttttttgagatggagtcttgctctgttgcccaggctggagtgcagtggcgtgatctcggctcactgcaagctctgcctcccagattcacgccatcctcctgcctcagcctcccgagcagctgggaccacaggtgcccgccacaacacctggctaattttttgtatttttagtagagacggggtttcaccatgttagccatgatggtctcaatctcctgacctcgtgatctgcctgccttggcctcccaaagtgctaggattacaggcatgccgcattgc

SEQ ID NO: 146 - DNA, 601 bp, Human
tcacgccatcctcctgcctcagcctcccgagcagctgggaccacaggtgcccgccacaacacctggctaattttttgtatttttagtagagacggggtttcaccatgttagccatgatggtctcaatctcctgacctcgtgatctgcctgccttggcctcccaaagtgctaggattacaggcatgccgcattgcgttttatataattctcatggttctagtctcgagctgtaggattttgatcactgtttcaaacaataatgtgagtttgctaagaggtctaaataacaaaagctaagtgttccaaacacatatccaaacctatacactgggcaatgcatctgaattatatgtgaaatttcctgccattatttaagacacaaaaggaacattattttgataatgtatttatttgtgagtggagtgttcagaatgagcacgatgggtataacatttttgtaggtttttaaagttgaaatttagtgtaaatccaaagaatcaatagacaagtctgtgttttacttaacctatatgtttaaattagcatttttagatactgattttattcctaatttcagaattctcagcgtcttgccgatcaa

SEQ ID NO: 147 - DNA, 601 bp, Human
ttttgtaggtttttaaagttgaaatttagtgtaaatccaaagaatcaatagacaagtctgtgttttacttaacctatatgtttaaattagcatttttagatactgattttattcctaatttcagaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaaggtaaayggtgtaggagtctgcctgtttgacttaattttgtttcccactccacattaaaagatcctttttgcttttaatagggtagaaattggcttcataaagctaatacagaatctcagagcctcatccttcaagctaatgaagaattgtgtccaaagaagttgcttctgcctaggttcatttttcagtttttttcttgtaacttctgcattttttgttgctatttatgtgattcaaattataccagtttataggcctctcacaagtaaaatgaattacctgtttgtttttgtatgcctattttag

SEQ ID NO: 148 - DNA, 601 bp, Human
tttgtaggtttttaaagttgaaatttagtgtaaatccaaagaatcaatagacaagtctgtgttttacttaacctatatgtttaaattagcatttttagatactgattttattcctaatttcagaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaaggtaaacrgtgtaggagtctgcctgtttgacttaattttgtttcccactccacattaaaagatcctttttgcttttaatagggtagaaattggcttcataaagctaatacagaatctcagagcctcatccttcaagctaatgaagaattgtgtccaaagaagttgcttctgcctaggttcatttttcagtttttttcttgtaacttctgcattttttgttgctatttatgtgattcaaattataccagtttataggcctctcacaagtaaaatgaattacctgtttgtttttgtatgcctattttagt

SEQ ID NO: 149 - DNA, 601 bp, Human
acagtttatttggcactggcaaggatcaaacagagagttggtggaaggctttttcccgtcagctgatcactgagggattcttggtagaagtttctcggtataacaaatttatgaagatttgcgcccttacgaaaaaggtaaacggtgtaggagtctgcctgtttgacttaattttgtttcccactccacattaaaagatcctttttgcttttaatagggtagaaattggcttcataaagctaatacagaatctcagagcctcatccttcaagctaatgaagaattgtgtccaaagaagttkcttctgcctaggttcatttttcagtttttttcttgtaacttctgcattttttgttgctatttatgtgattcaaattataccagtttataggcctctcacaagtaaaatgaattacctgtttgtttttgtatgcctattttagtcagtttgggggaagggatctgtgaggaaaggataagtcatagagcacttttcttttttaagagacagagtctctctgtgttgctcaagctggagtgcagtggtgcgatcatagcttactgcagcctcgatctcgtgggcccaagtaatcctcagcca

SEQ ID NO: 150 - DNA, 601 bp, Human
agatttgcgcccttacgaaaaaggtaaacggtgtaggagtctgcctgtttgacttaattttgtttcccactccacattaaaagatcctttttgcttttaatagggtagaaattggcttcataaagctaatacagaatctcagagcctcatccttcaagctaatgaagaattgtgtccaaagaagttgcttctgcctaggttcatttttcagtttttttcttgtaacttctgcattttttgttgctatttatgtgattcaaattataccagtttataggcctctcacaagtaaaatgaattrcctgtttgtttttgtatgcctattttagtcagtttgggggaagggatctgtgaggaaaggataagtcatagagcacttttcttttttaagagacagagtctctctgtgttgctcaagctggagtgcagtggtgcgatcatagcttactgcagcctcgatctcgtgggcccaagtaatcctcagccacctgagtagatgggactacagacatgcactactatgcccagctaatatattttaattttttgtatagagacagggtcttctagtgcttcctaggctggtcttgaactcctgagc

SEQ ID NO: 151 - DNA, 601 bp, Human
gatcctttttgcttttaatagggtagaaattggcttcataaagctaatacagaatctcagagcctcatccttcaagctaatgaagaattgtgtccaaagaagttgcttctgcctaggttcatttttcagtttttttcttgtaacttctgcattttttgttgctatttatgtgattcaaattataccagtttataggcctctcacaagtaaaatgaattacctgtttgtttttgtatgcctattttagtcagtttgggggaagggatctgtgaggaaaggataagtcatagagcacttttcttttttaagagacagagtctctctgtgttgctcaagctggagtgcagtggtgcgatcatagcttactgcagcctcgatctcgtgggcccaagtaatcctcagccacctgagtagatgggactacagacatgcactactatgcccagctaatatattttaattttttgtatagagacagggtcttctagtgcttcctaggctggtcttgaactcctgagctcaagtgatcctcctgcctcagcctcccaaactactgggattacaggcatgatccaccgctcccagccagaacattttcttg

SEQ ID NO: 152 - DNA, 601 bp, Human
gattgatcacttgtgagttttttctttcaaacatcttaaagcttccagagctttttctagaaaaaaaaaccagttttaagaatcaccagttctaaaagggtaatatcttattcatctttctgagaatggagtatcatgattcatgaattagatacttgcatcttaacatttgaaataatttaattttattattttttagttcgaaaactgtatcttcgggcaccaaagagcattgttataatcaagtaccagttgaattaagtacagagaagaaggtttgttttaaagaaattgttctgayttatttcattctttattgattcaaattctgtttaaaattttatattttaattcctttccaattaaagagaaaatggcatatataacaaagcataaaattcggccagggaagtgatgtgaacagactaaaatttattgtatataatttctggggctaataaagaattggaggtatttgagaaaggaattaatttgggttcttttaaacctatctgctaactcatttggcttagagtagtcacatgttataatacttatagttgatcaaaaaattgattcctaagtgttcttattaaagaca

SEQ ID NO: 153 - DNA, 601 bp, Human
ttgttagaagctgatgcagctggtgactttaagttgaagccagtgctcaattagcattctgaaaatcctagggcccttaagaattatgctatatctactctgcctttgctacatacatgtaacaacaaagtcttgatgatacctgtttacagcatggtttcctgaatactttaagcccattgttgaaacctgcttagacaaaagattcctttcaaaatgttattgctcattgacaacacttagtcaccaagagccgtaatggagacatacaaggagactaacgttgttttcatgcctgctygcttaacatccattctgtagctcatggatcaagaagtaaattaaccttttaagtattattatttaagaaatacagtttgtaatgctttagcttctgtagatagtgattatcagagatgggtttttaagaggttttccagaaaaccttctggaaaatattcactattctagaagtcatgaagaatatttgtgattcaggagagtaggtcagaatatcaatattaataggaatttggaagaagtcgattcttattaaaatcaagagtttagtgatagacatactgagtttgggatacctgtg

SEQ ID NO: 154 - DNA, 601 bp, Human
ataatgtcttaatagtttgagaaagaatatcatacctaccagcggtaattgagtaagttccctctctttggacacttgaaagtagtatcttctttcatgaattagtgatattatttaataatgaatgagtgatctctcctaactccccttcagaagaggaaaatgaagtaggggaaaaggtaaattccccaagggataggtatgaaacctttatgaaccttctggatagagaagatgactgctgatttctgtgattagaaattatacttgggttattctgcaaattgaaatgaattatttwaaaaaaaacaactttaatgtttattaagcaagttttgttattcatgagtttcattagccttttattttttttttaaattttgaagtaaaatttcttgctgtcacaatacacattaaaaattacaaatatgacacatattaaacacattaagatggccgaataggaaaaatatgctaaaatatttttatataaatacattttttgagaattttgagaatttctggaacaaagtaatgatataatccataaatgtacaattaaagagtttaaggatatccaaaatacttggcaaagtaatct

SEQ ID NO: 155 - DNA, 601 bp, Human
ctctttggacacttgaaagtagtatcttctttcatgaattagtgatattatttaataatgaatgagtgatctctcctaactccccttcagaagaggaaaatgaagtaggggaaaaggtaaattccccaagggataggtatgaaacctttatgaaccttctggatagagaagatgactgctgatttctgtgattagaaattatacttgggttattctgcaaattgaaatgaattatttaaaaaaaaacaactttaatgtttattaagcaagttttgttattcatgagtttcattagcctttwattttttttttaaattttgaagtaaaatttcttgctgtcacaatacacattaaaaattacaaatatgacacatattaaacacattaagatggccgaataggaaaaatatgctaaaatatttttatataaatacattttttgagaattttgagaatttctggaacaaagtaatgatataatccataaatgtacaattaaagagtttaaggatatccaaaatacttggcaaagtaatctgaaataatactcttaggaaggtagggcaagaatgtgattctagtaagcaaaaatgtaatcaaa

SEQ ID NO: 156 - DNA, 601 bp, Human
ctttggacacttgaaagtagtatcttctttcatgaattagtgatattatttaataatgaatgagtgatctctcctaactccccttcagaagaggaaaatgaagtaggggaaaaggtaaattccccaagggataggtatgaaacctttatgaaccttctggatagagaagatgactgctgatttctgtgattagaaattatacttgggttattctgcaaattgaaatgaattatttaaaaaaaaacaactttaatgtttattaagcaagttttgttattcatgagtttcattagccttttattttttttttaaattttgaagtaaaatttcttgctgtcacaatacacattaaaaattacaaatatgacacatattaaacacattaagatggccgaataggaaaaatatgctaaaatatttttatataaatacattttttgagaattttgagaatttctggaacaaagtaatgatataatccataaatgtacaattaaagagtttaaggatatccaaaatacttggcaaagtaatctgaaataatactcttaggaaggtagggcaagaatgtgattctagtaagcaaaaatgtaatcaaatc

SEQ ID NO: 157 - DNA, 601 bp, Human
agatttgaatattatagtttaattgtcaaggaaaatgcctcaacttaatctttgttaagagactacttaaggcactatcagaagttccctcatggcaaggtgcaatccctcatgcctgtaatcccagcactttgggaggccaaggcaggcaggttacctgaggccaggagttagaaaacaacctgggaaacatagtgagacccgacctctacaaaaacaatttcttaaaattagccaggcatggtggtgctagcctgtaatcccagctatttaggatgcttaggcaggaggattgcttgarcccggggatttgaggctgcagtgagccatcattgtgccacaatactccagcctgagtgatagaaaaaaaaaaaaaaagtgtctttgttatattccaaacttgttctcaactttcaggtgagctggcttcctgtataactcttgtataggacagaacatactggttggggcaagtgaaactgtctagttgtatgcctcataaattaatgaatttcctttctaatatatacactgatatttatacacacatacacataaaaccaagctcaatagatgggtagtgcagctctattccccaaaa

SEQ ID NO: 158 - DNA, 601 bp, Human
tggggtgaccagtctgaatagccaacaatgcttcctcagtaaatacccattttgtcttggtgggatttctacaaattgcaaaatgcagctattatgaagctgtaaaagagaaacagaaacatgtaacacctgggactgttttattaggcccaccgtatgctcagaacatgaaatctccactgctagggttatttgattgaaattatcttttgtgttgatgtgagagtttagctctgagattcttccacatgtaaaatgtaatcccccaaagtatttggcaagcacattttattgccttggstcagataattgaaacattaggcatcatatatatagcatgtaaaaagtaaaacagaaacatttatgtttctcaccaagcagtaaattagtactcaactaataaatttcttaaactccctaataacagaatatggaaacaaaaaataaatctttccaaaagaagagctcatggacacatttcctcatatatgtatacataatatagtagaacacatgataaataacctataaaaatgataccaatatcattcatcaagagacgaggctcttctttaaattattaatttcatctgttacaggt

SEQ ID NO: 159 - DNA, 601 bp, Human
ttctagagattgtatcggggtactgataaacacatttatagctcagggatactgcatcagccatattttaaaatgggactaacagtttaaaaactataaatattcacagtgttaagaaacaatctcaagatgcattaagaaaaaggaaggtgcaaaacagaaaaacaaacgtaaacgtgtgtgcatatgcatgcttatatagtcacatattcttgtatgtgtacaaaaaatacacactggatctctgcaagcatagccaagcaactggaaatatgtttttaaaaacttgcttttcattctrtctcttctagtactgttttgatgctctttgaaaacaatctaattgctgtaacaaatgaccatacgtaggccgggtgtggtggctcatgcctgtaatcccagcacttcgggaggctgaggcaggcagatcatttgaggccagggatttgagaccagttggacaacatagggagaccctgtctttactaaaaatacaaaaattagctgggcgtagtgacgcatgcctgtaatcccagatacttgggaggcggagacatgggacttgcatgaacccaggaggcagaggttgcagtgagctgag

SEQ ID NO: 160 - DNA, 601 bp, Human
gtttcttcattgttctaagataaatctttaaggctgttgaggttttttgtatacaaaatggagagtaagttttaatgggatgggacaaaatgaggcttacagttgagtttaatttgagttcacatcctgttgacattaagttgatttggaacaagtgatatggtccaatgcctgcttttctattgtctgtggttccatccactagtgcctgtgttacacacctcttgttcaggttttatcatttaaaataaataagaataaacagtccatagcttatcttacttactgaataaatgctctratttgacagtcatgtttcttaaagttccttacaaaggccattgcccaagaaaccaaataattccattatactatttttgaaatagaacacataataaatgggaattttaagttcagtttcttatgtaaacaataacttctatgtacatgttaaatatgcctgtatatacctaatttgaccatgtatgtatagtagaaatgaaaacagttactaagaaaatttgttattggctccaaattttctgaattaagtgtattctaatgctcagccataatatggggtttcatgtgttagtttatg

SEQ ID NO: 161 - DNA, 601 bp, Human
tatgcctgtatatacctaatttgaccatgtatgtatagtagaaatgaaaacagttactaagaaaatttgttattggctccaaattttctgaattaagtgtattctaatgctcagccataatatggggtttcatgtgttagtttatgtattcatggttaaaaatgtgaagactgttatatcttcatttgtgtcttttggtattatttggttgtattttattgtgtgatatggtggtataattatccttacctcccaggagtttgagagggtcttgccagttaaccgcagaattaaacatgcytaggactaattaatcaggagcaatactacaattaattggaggtaatttgaaacctggtttcaaataaccctgatattatgcacacatggtgcacacttttctagtagacatttaatgaaagtaatttaaaacctacctttgaaggatgaaaaacattgccttaaatgctctattctgtgaaagtatcaacatttatgcaaatacagtctaaattcagactttgaaaatgtattgaaagagaggatcatgaaataagttagagctgagtgacaaagctttctgagtgtttaaaagaatgtt

SEQ ID NO: 162 - DNA, 601 bp, Human
tttttttctaatttctatctcatcacttgcaaaaaccatatttttctccacattcattcccagtagcttcctgactcctagttcttccctaaatccttctgagtccttgtcattggtttcgcttgagtagcctttctaatcaacacagtcattggtatcagttactgtgacatggaagggacagaccaagttctgtgggccgctacgtagaaggatttcctgtcactttgctgcagaacctcagctcgcggagagcaagcccctttgcttgccctgtagaaatattttaaattattatcctttttttttttaacagaagtaaataggagatacgttagaggattttctctcctagatgtgtaaatacaaacttggggtcttataactcaataaatctgataaatttcttttgactgttaggatagagcagtggccataccaatagcctcatctccaaagctgcagtgaagatactttttactaccttaaagtctttcccatttgtgaacaacttgtgaacaattccccccaagaatttggaagatcactctctgaaagcacagtcaatactgtacttaaatggatctgagcaaaaataagt

SEQ ID NO: 163 - DNA, 601 bp, Human
agtaacagtagacgctgggaactactgaggggagggaaggaacaatggttgaaaaggtgggaagggacagtggttgaaaaactacgtgttgggtactatgctcactatctgggtgatgggatcaattgtacctcaaacctcagcatcctgcaatatactaatgttacaaacctgcccatgtactacctgaatctaaagtaaaagttataatttaaaaaaattataataaaatcagaaaataaaggtctgagatggaaaattaaaagaccaaagccacccataagcacaataaatccctccycccaaaaaattatatctattaaaaaaaggtgttgcgccaggcactgtggctcatgcctataatcctagcactttgggaggccaagacgggcagatgacttgacttgaggtcaggagttcaagaccagcctggccaacatggtgaaaccctgtctctactgaaaatacaaaaattagccagcagtggtggcatgcgcctgtaatcccagctactcaggagactgaggcaggagaatcgcttgaactggggaggcggaggttgcagtgagccgagatcatgccactgcacttcagcctgggt

SEQ ID NO: 164 - DNA, 601 bp, Human
aatgtattgtctctcagggcttaaagcaatttgcatctttcgatgagacattgagtaataggcaatattctctgaaataatttgtgcaggctgggcacagtggctcacacctgtaatcccagcactttgggaggccgaggcgggcaggtcactgaggtcaggtgttggagacgagcctgaccaacatggtgaaaccccgtctctactaaaaataccaaaattagctgggcttggtggcacacacctgtaatcccagctacttgggaggctgaggcaggagaattgcttgaacccccatggraggtggaggttgtggtgagccaagattgtgtcattgtactacagtctggacaacagagtgagactctgtctcaaaaaaaaaaaaatagaatttgtgcagttccccccacccccttttttttttctgttggcatttttgctatcatttagctgccttctttatatcctgaaacttacaggtggtgttggtctagtcagtaagagcaaaggctttgggaatagatagatctgtatttagaccttggctctagcatctcattgttatgtgacctccatcaagtgacctaatttccctaatatt

SEQ ID NO: 165 - DNA, 601 bp, Human
gaaataatttgtgcaggctgggcacagtggctcacacctgtaatcccagcactttgggaggccgaggcgggcaggtcactgaggtcaggtgttggagacgagcctgaccaacatggtgaaaccccgtctctactaaaaataccaaaattagctgggcttggtggcacacacctgtaatcccagctacttgggaggctgaggcaggagaattgcttgaacccccatgggaggtggaggttgtggtgagccaagattgtgtcattgtactacagtctggacaacagagtgagactctgtctcaaaaaaaaaaaaatagaatttgtgcagttccccccacccccttttttttttctgttggcatttttgctatcatttagctgccttctttatatcctgaaacttacaggtggtgttggtctagtcagtaagagcaaaggctttgggaatagatagatctgtatttagaccttggctctagcatctcattgttatgtgacctccatcaagtgacctaatttccctaatattcaatttcctcatctctaagacagggagttaatattgcctctcttatagaattgtgagaaatatagtcatgtgt

SEQ ID NO: 166 - DNA, 601 bp, Human
aaacctgtacagcatgtgactttactgaacactgtaggcaattataacacagtggtatttgtatatataaacatagtgaaacatagaaaaggcccagtagaaatacagtgtaaaagattttttaaaaaagctgggcatggtggctcacgcctgtaatcccagcactttgggaggccgaggcaggcagatcacttgaggtcaggagttcaagaccagcctggccaacatgatgaaactccgtttctactaaaagtacaaaaattagctgggcgtggtgttgggtgcctgtaatcccagctaytcaggaggctgaggcaggagaattgcttgaacccaggaggtggaggttgcagtgagtcaagattgtgccactgcacttcagcctgggagacagagcgagactctgtctcaaaaaaaaaaaaaaaaaaaagagataaaaaggtacatctgtacagggcacttaccacgaatggagcttgcaccctgggagttgctctgggtaagtcagtgagtgagcggtgagtgaatgtgaagacctaggactgtgcactgctgtagactttataaaccctgtgcacttaggccacactcacccctgtga

SEQ ID NO: 167 - DNA, 601 bp, Human
aaactatcatttctggatgtgagattgtgcttttggattcttattttttctttataaaatactttttgttctcttactggagaaaacattgttggattataaatgatataacaaggaatgaggatatacatactataataacgattcagatatgttattttcatattttatttaactgtagccatgccacaataatttagagttttaaagaacaagtttgattgaaatctaaactttgtacaatcctgaattgagaagtttcctgtattttattatgacacaatatttacctaaaaatagrgtaattatgaattgagaaaacatagctattaatttcatactcttatttgttaagtagattttgtctggaaaactgttcatatttaaaggagctttgtacctttgtattctttttgtttttccttgtttatataattttaaactctgtttatggatttgggattctaactatgctaaataataaattaaggcattgaatgaagtacctagacagtattttgattaattttattcccccattcttaatgtgcatgtaactggaaaattaagagtggcttccaagggatctactacaaaagta

SEQ ID NO: 168 - DNA, 601 bp, Human
tattagctgtgtaactttctcttcctgttttttgttttgttttgttttgttttttgctttttaactgcagtattttgaggagtcttggagtagcaagctaatctttggaagaaaggaaaatataaacctgaaaactaacaatttaaagaacgtcttttcaggttgtcatttgaaaaatacttgatttctgatcactgatttgaattgagtgtcaaatatttgatatgttttgtaaattaggtgaagatgagtgagtaggttctaaactgcttgggtttaccgcactctggagcattgcagragaatgtgatgttggaaggaagtgctgaaacataattattggcttgcctataggagggtgctacataattttagaaggtgtcaagaaagtgacacagtctgaattagttctgttgagttgcaaaaaatgtaaagtttcttgattctgaaaataagaaatatgttcccagaaatctcatctagttaatgtgcttttaaaatcattgatgtctcttgttattacaataatagccattgaaagaatcttttttattagaatgttatttacaggtacgattagcttctatttaaataaattatt

SEQ ID NO: 169 - DNA, 601 bp, Human
gtagcaagctaatctttggaagaaaggaaaatataaacctgaaaactaacaatttaaagaacgtcttttcaggttgtcatttgaaaaatacttgatttctgatcactgatttgaattgagtgtcaaatatttgatatgttttgtaaattaggtgaagatgagtgagtaggttctaaactgcttgggtttaccgcactctggagcattgcagaagaatgtgatgttggaaggaagtgctgaaacataattattggcttgcctataggagggtgctacataattttagaaggtgtcaagaaaktgacacagtctgaattagttctgttgagttgcaaaaaatgtaaagtttcttgattctgaaaataagaaatatgttcccagaaatctcatctagttaatgtgcttttaaaatcattgatgtctcttgttattacaataatagccattgaaagaatcttttttattagaatgttatttacaggtacgattagcttctatttaaataaattatttttatacttgatcttaggcaaaaggccaacaagtgatcagaataaattattttaagagaaaactaattataattgatatttggaattgg

SEQ ID NO: 170 - DNA, 601 bp, Human
aaaggccaacaagtgatcagaataaattattttaagagaaaactaattataattgatatttggaattggaagcacaatttcctttagaacaattccacgaatggttgttttgattctcaaggcagcccacaaaagacagtttgaaacacaatttatgcagtgtcaatagtactgacctgactttggatcttggaggcaggggcttcaggtgatacccgagtggagtttttactccatttccattccgtaaggctataggcatttgaaagaggaaacttttctttggcaaccttccaccttyctttctacagaatatttcagtatttctagctcataggttttctaaaatattctctgtaatttattttgaaatggagtttttttatcgtttacagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatact

SEQ ID NO: 171 - DNA, 601 bp, Human
gcaggggcttcaggtgatacccgagtggagtttttactccatttccattccgtaaggctataggcatttgaaagaggaaacttttctttggcaaccttccaccttcctttctacagaatatttcagtatttctagctcataggttttctaaaatattctctgtaatttattttgaaatggagtttttttatcgtttacagatatgagtaaaattagcctaatcagaatgttagttcctgaaaacattgacacgtaccttatccacatggcaattgagatccttaaacatggtcctgacagyggacttcaaccttcatgtgatgtcaacaaaaggagatgttttcccggttctgaagagatctgttcaagttctaagagaagcaaggaagaagtaggcatcaatactgaggtattaattatatatagaattttcataaagtgtcagtttgttcaatttgcatatcctagtactagaatgctgtatttttttgaactgttatgaattctgatatgattactttctctatgtgctacatttcctttgcttttcataaatatgatctgagaaaagtgattaaaaaaaagacagtaaaagggaggt

SEQ ID NO: 172 - DNA, 601 bp, Human
gatttaagcatatggcagtttatgtagttaatgaaagtgaaaacaaattgtattataaatacctcccaaactggtttattatcattctatcattcttcatgctctgttagtatgatattgaatatctgaggtaccaggattattgttgcttgtggctctgagcatttcgtagtgcttttgcatgatgagagaaagattacaaatttagtattatgttagatggtacgttttattaaaatcaaatgcttcaaaaataattgctctgtgtatggcatgagataaatagcaatcagatatattrtttaataatatgactctattaaatgatggcataaatttgaaaatttgaccttcggtatcttccgggtctaaaattatatgactccattataaatattttggaaatgattaactaaaaaattgtttcaattcttagttggtaaattcaatgtggtagtaggtggtggtgattattttgtattagagaattaggaattacacttagttctaaggtaatctttataggatgtccagcaattaaacccctacttttttgaattgcttaaaaataagggaactgatctttttaaattctgtactt

SEQ ID NO: 173 - DNA, 601 bp, Human
tcaacctgtcagtatagaaaacggtgtaacttactattttttctcaatattgaagcacatttgtagtgaaatattattttaactatatattgccatttttgctttttccctatttcagtaacatttttcgctatttcagtaacattacatgtcaacaagagaatggtgggtattttggggggggttgggtgggaagaaattttactaagcttgctagattctaaaaggtataccttatttggccccttttccccatttaggggaacaagggtgttggggctgggaagtagataagaggtgagtaagtcatccaaagcatatgtcttcattagcctccctgtatgaaaagctgatttctgtagagtgttggaggcctactttcagaatctgtcatatgttaacattcatcttctctactgacctgatttatatcccttagtctatttcattttataattatgacaaaggataaagtcattagaacaaattctttttattagttgacgtattgttgtgtttatatctcttgtgtttgttattaagatggaagctcaatcatgtccttgtttaacagaaaggtgatgtcttggcattgataatt

SEQ ID NO: 174 - DNA, 601 bp, Human
tttcctaatgttttccagctcatttggaaaggctacagttttattctgtacctaagcaagtctttctggtgtcaaagatttgaccttgatacttttcttttgctcattttcgtatgagattagttttcctgtactttcaaaagaaggcgtggttcaagatggctttcccaatttcacatctgtctctaatgtttttgtgtaatgtctaaaatatggaaacttggtttatgagatctactctgccatttttatctgggctttctcttccttttgtctctgttgtacctgtcctgcttggttytgatttaaccccagtggtttctcctgaatgtggagccttctcctagaaggcagcctcggctagtcccagggttcagagtagccagctgctctcttcacctaagagaccactgtggattccttgtactcacttgctattggcttggacaaaagccctcccattttcagatgctattatcagattaatctctcattaatctgtctttccagtgtatgcctgtgggctatcttggggttctcttgttatcagacacctccctgctggcctctgctttctcccgtacagatgtcagtactgtgc

SEQ ID NO: 175 - DNA, 601 bp, Human
aggaagggaacaaacttaacttagaaaagcaagtatctatttggacagctcttaacacttttttctccttgaactgtctaataaaacacaacaacatttttgtggcttgccagataataaatgagatcaaacagaccaagatttcatattgaggagtgctttaggtctcagtgaagtacaggttctgtagattttattgggagaaactgaggactaggccctgcttcacaggcaatgaacagtggggcacacacgagacatgttccctctgggttgggctcccctgacatcaggctatgamgcagacagctgtgcacacactgtactgtttaacacacatgggaagtcattattgcacatgccactcggtcactgtctctattttatgatgagaaccaggagggtgtgagatttgcctgcatcatgggcagctggtttcacagccgggactcttggcttggctctgcagtgctcggctgcactgaaaaaagggccagctatggctctactttccctgtcagcttgtcatctgctgctcttgaccttggtcttgtctttgcagtgtgagacatccatggatggagaggcgggactctgctgg

SEQ ID NO: 176 - DNA, 601 bp, Human
agacagctgtgcacacactgtactgtttaacacacatgggaagtcattattgcacatgccactcggtcactgtctctattttatgatgagaaccaggagggtgtgagatttgcctgcatcatgggcagctggtttcacagccgggactcttggcttggctctgcagtgctcggctgcactgaaaaaagggccagctatggctctactttccctgtcagcttgtcatctgctgctcttgaccttggtcttgtctttgcagtgtgagacatccatggatggagaggcgggactctgctggtgygtctacccttggaatgggaagaggatccctgggtctccagagatcaggggagaccccaactgccagatatattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaata

SEQ ID NO: 177 - DNA, 601 bp, Human
ctgtctctattttatgatgagaaccaggagggtgtgagatttgcctgcatcatgggcagctggtttcacagccgggactcttggcttggctctgcagtgctcggctgcactgaaaaaagggccagctatggctctactttccctgtcagcttgtcatctgctgctcttgaccttggtcttgtctttgcagtgtgagacatccatggatggagaggcgggactctgctggtgcgtctacccttggaatgggaagaggatccctgggtctccagagatcaggggagaccccaactgccagatrtattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttc

SEQ ID NO: 178 - DNA, 601 bp, Human
tgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagsatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaatactgttatctctgtggatgtttatttagtgatattatctttttgaa

SEQ ID NO: 179 - DNA, 601 bp, Human
gtggactaaatgcctccttcatgattagcaccagggggcctgtctttctgagtctgtcaaaatctattctacaaatataaaaatatcgttagaaaagtaggtgttaattttaaatataatttttgctgcagcttatgaagtacattgaggaagtgtttataaaggggattctttttctagtgtattatttggagacgcagcttctactgtaggcttaccttcaaatcaaagataatacattcttttatagtattagatgtagagcaactttctccctcttataatctgtataaccattagsatactaacaacaagaagaaaattactctgaatactttaaaatgataaataggccaaggacttcaatgagctgtagaggatacatattacatccaaaatcagtctaccacattgtactcacattttgttggcagccttcgagtgtaaaagggcttttactggtgcacacctcgggcccaggggcagtgcctggaaccaagttgaggctcagacactattcagacgtcaccttcctccttggggtggggttaggggagtggtagcttgtccatgaactcagtgtgctatcgtctttgttttg

SEQ ID NO: 180 - DNA, 601 bp, Human
cccagaagagaccattggatcagacgtgtgactcagcagactccagctgtagccaaatccacacatctttcaagtctaaagagttttggttacttgaatttactgagaagactgagcaaagggaagtttagtgatatcacgttaaaattttatgaagtccaaaagaatgctagatttccaaatttacttgtgagagacaaaaggatacaagtgtgtgtcattgtgtacataaagtttcggtctcacccctgtacaatgacctttatttgcaatagatggcattcctggtaagttgcttctragttggatttgtgcaaaggatttcccactgacttagcctatgatctcttcacttctttggttttttgtgtgtttgttttttggttttgttttgagacagggtctcactgtatcacccaggctggagtgcaatggcataatcatagctcactgtaacctggaactcctagtctcaaacaatccttctgctcagcctcccacgttgctgggaccacaggcacacactaccatgtctggataattttaaaaatcttttcacttctgatttttcattgccaagggcttctagtaatggtgcctt

SEQ ID NO: 181 - DNA, 601 bp, Human
gctagaataaatatcgtaaaatggctttgaagttgaaaggaattttggggggggaatccttttatgaagaatttttttttttttttacagtttgagaggaaaaataatgtattttgagaatgtgttttccttaatatttgttaaatgagtagactgtattcttaaggtttagaaaggacagaaacaagtttgtgcttagttcttctgaattcgttgatatcccttgttgctgttcacaatacacccactcccagccctccgtgatggagataactctgttccccacaactagggcttgccsactctcatggtacttctgatgtttaattcttttggctgtgtctgcatttcctcatttacttttaatttgcttatccctagaacataccttttgagtgcctaaacttttttatcttcctgtcctgaagacaaaaatttaatctgtgaattaaacccatggagaagtatcatttatgaagggattggtacatattgatgcatgatgatgaaatgtgtcttctggtttatgtccattgcaggaaatagattggatttaggatgatgggacatctcattagaggggaaatttcctgatcttgac

SEQ ID NO: 182 - DNA, 601 bp, Human
aagttgaaaggaattttggggggggaatccttttatgaagaatttttttttttttttacagtttgagaggaaaaataatgtattttgagaatgtgttttccttaatatttgttaaatgagtagactgtattcttaaggtttagaaaggacagaaacaagtttgtgcttagttcttctgaattcgttgatatcccttgttgctgttcacaatacacccactcccagccctccgtgatggagataactctgttccccacaactagggcttgcccactctcatggtacttctgatgtttaattmttttggctgtgtctgcatttcctcatttacttttaatttgcttatccctagaacataccttttgagtgcctaaacttttttatcttcctgtcctgaagacaaaaatttaatctgtgaattaaacccatggagaagtatcatttatgaagggattggtacatattgatgcatgatgatgaaatgtgtcttctggtttatgtccattgcaggaaatagattggatttaggatgatgggacatctcattagaggggaaatttcctgatcttgactaaggcatgcttcctgccccacgtttaaa

SEQ ID NO: 183 - DNA, 601 bp, Human
aatccttttatgaagaatttttttttttttttacagtttgagaggaaaaataatgtattttgagaatgtgttttccttaatatttgttaaatgagtagactgtattcttaaggtttagaaaggacagaaacaagtttgtgcttagttcttctgaattcgttgatatcccttgttgctgttcacaatacacccactcccagccctccgtgatggagataactctgttccccacaactagggcttgcccactctcatggtacttctgatgtttaattcttttggctgtgtctgcatttcctcrtttacttttaatttgcttatccctagaacataccttttgagtgcctaaacttttttatcttcctgtcctgaagacaaaaatttaatctgtgaattaaacccatggagaagtatcatttatgaagggattggtacatattgatgcatgatgatgaaatgtgtcttctggtttatgtccattgcaggaaatagattggatttaggatgatgggacatctcattagaggggaaatttcctgatcttgactaaggcatgcttcctgccccacgtttaaaattcaggatctcttccttaaaacat

SEQ ID NO: 184 - DNA, 601 bp, Human
gcagctagaagggtaagtgccccaaatttcatgagctgacgttctattacaaaataagcagcgtgcttatgaaactgtgttgctgaggtaagagccctccctgccttgttaaagagaagaaaggaggaagccgcagtattgcctgtgctgctcgagtaggtcttgggtggagtcatggttctccattcttaggaggttgctgtttggaaaacagagatgttatcacccttactggattttgcctcatcagtcaagggttgcgtgtctgactgtgaccagtgagacggcagacgggggtgcrcttagggcttttctgccaagaatgacagcagttggtctggagtgctcacctccctgtgaaatcattgttcgcgcgaccctcatctgcctcaggatgctgtactctactacgcacaactgctccatcttttaagatattggaagtgagagcacgggaggagcatgggcggttcgttttgttagaaagaaacccggattcacgagatggtttttattgattagtttacaggatttgcactattgatagagtttttgccttggcacaggcctgctttgtgataggggttttaaaataaccgtg

SEQ ID NO: 185 - DNA, 601 bp, Human
caaatttcatgagctgacgttctattacaaaataagcagcgtgcttatgaaactgtgttgctgaggtaagagccctccctgccttgttaaagagaagaaaggaggaagccgcagtattgcctgtgctgctcgagtaggtcttgggtggagtcatggttctccattcttaggaggttgctgtttggaaaacagagatgttatcacccttactggattttgcctcatcagtcaagggttgcgtgtctgactgtgaccagtgagacggcagacgggggtgcgcttagggcttttctgccaagartgacagcagttggtctggagtgctcacctccctgtgaaatcattgttcgcgcgaccctcatctgcctcaggatgctgtactctactacgcacaactgctccatcttttaagatattggaagtgagagcacgggaggagcatgggcggttcgttttgttagaaagaaacccggattcacgagatggtttttattgattagtttacaggatttgcactattgatagagtttttgccttggcacaggcctgctttgtgataggggttttaaaataaccgtgggcttttcactggaggataaaa

SEQ ID NO: 186 - DNA, 601 bp, Human
gtacctttgcatatgtacttttctctttaaactctcccttttaaatacgactcttgccaggctttaagtgaatgcttcaaaataaaaggagttatcaattaaagagtgaattccttccaaagagaatttgggaaaataatttaggaaaagaagaggcgagaaggtcatgggaaaggttgtctttgctgatttatctgccccaactggataaagttactgcataagggtttctttacagcctccctgtttttctcagactaactcttggtcagtcttaaattcttaaaattccatcatctgwtagagctaacgagagcgggcagctcttcattccatccttgaaaagcacagtgtcctccccactggggaacaccaatccttaaaaaacttctttctcattgcaaatcgaaggaggctgccgctgcacccagccccagactcctcagtcacttacctggcaagctgaggccctaccagtttaaggtgatgattattgtttcttgtattaaattttaaaatgaatttttctccgctttttttttttctaagtaggtttgtgtttctggaatctcgggtgtctgtgagcatttcttcttcagca

SEQ ID NO: 187 - DNA, 601 bp, Human
tcagactaactcttggtcagtcttaaattcttaaaattccatcatctgatagagctaacgagagcgggcagctcttcattccatccttgaaaagcacagtgtcctccccactggggaacaccaatccttaaaaaacttctttctcattgcaaatcgaaggaggctgccgctgcacccagccccagactcctcagtcacttacctggcaagctgaggccctaccagtttaaggtgatgattattgtttcttgtattaaattttaaaatgaatttttctccgctttttttttttctaagtagrtttgtgtttctggaatctcgggtgtctgtgagcatttcttcttcagcagagcagtagctgtcaaattttcttgttgcttaatgatatacttttttgtttctagactaagcaaatgatagacatagaggtgaatgctgagaggagagtttaattaatttccattaggaattattatgtggttaccttttcatggagtgttaactaagtattgtgcacttaaatgtagttagaaattaaagcctgatttttatttgcaagaatatttatgatgtctttctcattatctgaaacttgcataaa

SEQ ID NO: 188 - DNA, 601 bp, Human
cttacctggcaagctgaggccctaccagtttaaggtgatgattattgtttcttgtattaaattttaaaatgaatttttctccgctttttttttttctaagtaggtttgtgtttctggaatctcgggtgtctgtgagcatttcttcttcagcagagcagtagctgtcaaattttcttgttgcttaatgatatacttttttgtttctagactaagcaaatgatagacatagaggtgaatgctgagaggagagtttaattaatttccattaggaattattatgtggttaccttttcatggagtsttaactaagtattgtgcacttaaatgtagttagaaattaaagcctgatttttatttgcaagaatatttatgatgtctttctcattatctgaaacttgcataaaacctgaagcatcagcaaaatctttttaaggttgcgtgctcaggtgtttgggaggctttccaggtaagcccgggcccctggcctgctcttaccattttagatgcaggggagggcaagtgggccttgggttttccctgctgctgctgctccccagtagtcctgcagctccaaggatgctggctccagcctttcattcct

SEQ ID NO: 189 - DNA, 601 bp, Human
atttcttcttcagcagagcagtagctgtcaaattttcttgttgcttaatgatatacttttttgtttctagactaagcaaatgatagacatagaggtgaatgctgagaggagagtttaattaatttccattaggaattattatgtggttaccttttcatggagtgttaactaagtattgtgcacttaaatgtagttagaaattaaagcctgatttttatttgcaagaatatttatgatgtctttctcattatctgaaacttgcataaaacctgaagcatcagcaaaatctttttaaggttgygtgctcaggtgtttgggaggctttccaggtaagcccgggcccctggcctgctcttaccattttagatgcaggggagggcaagtgggccttgggttttccctgctgctgctgctccccagtagtcctgcagctccaaggatgctggctccagcctttcattcctgcgtgcagcttctaagaggctctttcttgagcttgggctcttaagaatcttttacctcccgatgggaagttttctctcaccctgtcttcctggcccatgaccacaaaggtatagcccatcctcacgatgatgagctc

SEQ ID NO: 190 - DNA, 601 bp, Human
ctctgctgtttacaaaggaaacaggttttgtaatccacatgtacacaatttttataaaatagctaatttttaagctcttgagtaagagaatattttcactatctggaaaatccccttgtttggacaaccttgtttcctgatggcatcagataaataaggagttaaagtttcacattatttggtgctaccaaggattgttgccttgaaaagaagaaggaaaaagtagatggagggtggtgagttaaaagaattgaaattcgcggataggcatttctatgcttttgttcctaccactcgactstgcaacacgcagtgctttgtaataccttcttggagctcaaaggtcaggctgaaacatggccgctttttcacatttccctgggacttttggaaaatatacaccaaccctgtgacctagcaattccgggatccacccaagagaaatgaaaacatgcccacacaagacttgtgtatgaatgctggtagcagtattactcataatagcctcccgggattcccccgacccccagcccaaaagaaagacccactggaaaccattcagatgttcatcagcagatgagtggatagaaagataaatgga

SEQ ID NO: 191 - DNA, 601 bp, Human
gaagaaggaaaaagtagatggagggtggtgagttaaaagaattgaaattcgcggataggcatttctatgcttttgttcctaccactcgactgtgcaacacgcagtgctttgtaataccttcttggagctcaaaggtcaggctgaaacatggccgctttttcacatttccctgggacttttggaaaatatacaccaaccctgtgacctagcaattccgggatccacccaagagaaatgaaaacatgcccacacaagacttgtgtatgaatgctggtagcagtattactcataatagcctccygggattcccccgacccccagcccaaaagaaagacccactggaaaccattcagatgttcatcagcagatgagtggatagaaagataaatggataaatgaaatgtggcacaaaggacaactgactactcaacaataaaaagacgtgaagtatgacacgtgttacaacatgggtgaacctctaaaacattaggctaagtgaaaagaaaaaatccagacacaaaagactacatattatatgactcattcgtatgtaatttgcagaaaaggcaaaactatagagacagaaagcagaccagggatg

SEQ ID NO: 192 - DNA, 601 bp, Human
cggggagccttgccccaagctgtggctcgaaaaacaagcatggtattgacaggcagctcatgaatggcttgattattattttgacaagggttttatttttatttttctttagcttccacaggctccataatgcctgggttttattgatattggtatcctggctcccagcctcttcaatgattgtaaaaaatgtttgtgtttactgtaaaaagataatcttgcttttcaaagtgattagtcaaatacacagaatttcagtgtgcctgccattcatttgtcaaattcctggtttataattcakgcttcctcccgtgggggagaagaatgttttgttcagaaggtatttttggtgtggttccgttccctgctagtgaaattagtttatgaaaagaggcctggttctgggtgtagatggaagtttggcctgattaattggtccttaccggcagcccagaggtttcttcatcaacaaggagattttgtcctgtaactaactcaggtacctggaagcagcccgacatttgggggtgcatcgctgcagtctcctttggagctggagaaacctatgagcaagaatgggcttatgacacatccatttcca

SEQ ID NO: 193 - DNA, 601 bp, Human
tgccattcatttgtcaaattcctggtttataattcatgcttcctcccgtgggggagaagaatgttttgttcagaaggtatttttggtgtggttccgttccctgctagtgaaattagtttatgaaaagaggcctggttctgggtgtagatggaagtttggcctgattaattggtccttaccggcagcccagaggtttcttcatcaacaaggagattttgtcctgtaactaactcaggtacctggaagcagcccgacatttgggggtgcatcgctgcagtctcctttggagctggagaaaccyatgagcaagaatgggcttatgacacatccatttccactccatccctccttccgttgtatgactgcatggagcccctctgacctccagcagtgtcacctgcagcctggtagtgagaaacagcaggtatggatggggtctacccccagcaacagtagcgccagctgggccatatcctggcactgctccccaggaaacacaccttgtgttgcattgaccagatctgggatcatttggacaatgtcttatgctgcttttccaggatagctgtgtgttcaggagggagcccttactgaaaggaaa

SEQ ID NO: 194 - DNA, 601 bp, Human
ttcctggtttataattcatgcttcctcccgtgggggagaagaatgttttgttcagaaggtatttttggtgtggttccgttccctgctagtgaaattagtttatgaaaagaggcctggttctgggtgtagatggaagtttggcctgattaattggtccttaccggcagcccagaggtttcttcatcaacaaggagattttgtcctgtaactaactcaggtacctggaagcagcccgacatttgggggtgcatcgctgcagtctcctttggagctggagaaacctatgagcaagaatgggctwatgacacatccatttccactccatccctccttccgttgtatgactgcatggagcccctctgacctccagcagtgtcacctgcagcctggtagtgagaaacagcaggtatggatggggtctacccccagcaacagtagcgccagctgggccatatcctggcactgctccccaggaaacacaccttgtgttgcattgaccagatctgggatcatttggacaatgtcttatgctgcttttccaggatagctgtgtgttcaggagggagcccttactgaaaggaaagaactgttgacttacaag

SEQ ID NO: 195 - DNA, 601 bp, Human
catgcccagctaatttttggatttttagtagagacgggatttcatcatgttggccaggctggcctcaaactcctgacctcaaatgatccacgtgcctcagcctcccaaagtgctgggattacaggcttgagccaccatgccctgtccgattatttttcagggaagagccagtgtgctccagccctatgagctctacccttctgctcccacagaagggaagcacaggcctgtggggtggagggggctctgccctaagcgcagcccctgtgggccacgggtttcctgtcccttacactcggcygccttgtttctcccaccccaacatgaaaaagatggagtgagcctgcagccctgagttgatattgctttttaaattgagaacaatataattacagccttgtactggttataaaactttaaggtctcatatcagagatacagcagtgcctttctcatctaaccctgtgtagaatacggctgttgagaatggcgtggctctctggctggatagggttataaaagtaaatcgtcttttcacctttggcttttaataagggaagggtattagaaaaaaagtaatttgtatgatgaagggtgattt

SEQ ID NO: 196 - DNA, 601 bp, Human
caaagtgctgggattacaggcttgagccaccatgccctgtccgattatttttcagggaagagccagtgtgctccagccctatgagctctacccttctgctcccacagaagggaagcacaggcctgtggggtggagggggctctgccctaagcgcagcccctgtgggccacgggtttcctgtcccttacactcggctgccttgtttctcccaccccaacatgaaaaagatggagtgagcctgcagccctgagttgatattgctttttaaattgagaacaatataattacagccttgtactgkttataaaactttaaggtctcatatcagagatacagcagtgcctttctcatctaaccctgtgtagaatacggctgttgagaatggcgtggctctctggctggatagggttataaaagtaaatcgtcttttcacctttggcttttaataagggaagggtattagaaaaaaagtaatttgtatgatgaagggtgatttgtgcgtgtgtgcagacagacacacatgcagggaggcaaatcagaaccgatgcgtgtttggctttggcttgtttcgctggtgtctggatttacctggcgacacttg

SEQ ID NO: 197 - DNA, 601 bp, Human
aagatggagtgagcctgcagccctgagttgatattgctttttaaattgagaacaatataattacagccttgtactggttataaaactttaaggtctcatatcagagatacagcagtgcctttctcatctaaccctgtgtagaatacggctgttgagaatggcgtggctctctggctggatagggttataaaagtaaatcgtcttttcacctttggcttttaataagggaagggtattagaaaaaaagtaatttgtatgatgaagggtgatttgtgcgtgtgtgcagacagacacacatgcrgggaggcaaatcagaaccgatgcgtgtttggctttggcttgtttcgctggtgtctggatttacctggcgacacttgttgctctgggggatcttagagggaagcacgctgactgacctagggctgaacagcaggctgacgaccagcgccgcctcccgccccctgctcactctatccctgcaaagcccctgccttgctccctgttcagatcatagtaaaatcggatgtatccgagtatttcagagtgcttgtctccttagagtcagccagtctgacctgtcagatcataatacgtagtagcc

SEQ ID NO: 198 - DNA, 601 bp, Human
cctgactacagggatctcatcagcttcaccgtttactacaaggaagcgtgagtttctgctttgggtgatgccattctgttgacagggctacgaatgggagaggccagtctttcgatccttgaatgggctggctgaatacagggggtcagcagagtccccagggagagccacgccaaacatccctacttcatcctcatgcaccctctcgggctgtccctgtgatgtcagtcacagccagtgacagccatgattgggaaagtgttagctcgaggcctgtcattctttagtgagtgattagagrtgtttgaataaaataaacccaaaatggggaaagcttgctttttccagaattaggtcagtccagactcatgaacgatgatgggggacttcactgaaatatcgtttcagcctccttacctactaggcctactccaggaacaccctgcaggcacgtggctcttttgtatcatcttattcctgtctctctctctgtgtgcctctcccaagctgtggccctctgctctaggtcatgagccttccaaacaagcgaagaaaagtggagagagaacaaccttcatgtcttgagccttttgtgacttct

SEQ ID NO: 199 - DNA, 601 bp, Human
caaggaagcgtgagtttctgctttgggtgatgccattctgttgacagggctacgaatgggagaggccagtctttcgatccttgaatgggctggctgaatacagggggtcagcagagtccccagggagagccacgccaaacatccctacttcatcctcatgcaccctctcgggctgtccctgtgatgtcagtcacagccagtgacagccatgattgggaaagtgttagctcgaggcctgtcattctttagtgagtgattagagatgtttgaataaaataaacccaaaatggggaaagcttgytttttccagaattaggtcagtccagactcatgaacgatgatgggggacttcactgaaatatcgtttcagcctccttacctactaggcctactccaggaacaccctgcaggcacgtggctcttttgtatcatcttattcctgtctctctctctgtgtgcctctcccaagctgtggccctctgctctaggtcatgagccttccaaacaagcgaagaaaagtggagagagaacaaccttcatgtcttgagccttttgtgacttctcctagactctgttgggagcttttcctgtgtgatcacat

SEQ ID NO: 200 - DNA, 601 bp, Human
ttcactctatagcactgataaacattctttgataatagccattattttagtgggtaaggtgtttttaaatacccataagcgagcacaaaatcagtttaaatggcagagaggagggtgagaagaaaatgctggtggggaaaaccttttgctgtgcacgcctgctccttcctccactcctaccccatctccatgaccctgtaagtggccacagtcatgtcactgggtaaagtgcttattgaaacaaaattggcacaggcttctgatcctgcgtgtgggttggtgtagcagaggttcagtgcarcagaagaagtttttcatcttaaaatttggaagtaacccctggccagcaattcactgtagtgtttgggaaacataggaatatctgcttattgtgacagattctcaagaaacctgtttcctttccgcaaagatggaaaccaggcactgtaccaatgagtcagttcactacgttttgtcctctgtccttacacgcagcggagacagacgagaacttggtcctctgcctctgctgtttggtgacacctatcgtaagaatgtatctaggaatgagctgtttgtttttgaagtacttatttttgga

SEQ ID NO: 201 - DNA, 601 bp, Human
ttggtcctctgcctctgctgtttggtgacacctatcgtaagaatgtatctaggaatgagctgtttgtttttgaagtacttatttttggaaaccctaaagtggctgagcatcaagtggttgtgttttctctgaaaacgccagtattagtcataacctttttccaaagtatcatcccttaaagatgttcagaaccttgtgtgtatcgtataacctggagcaccctcaagctgtccgcccttttcaagttttaaaaatggcttaggcaaacatattgcttaagtgatatccagtgaaggtgtcycctgtgctttgaaaaaccatcaacattgatgcttttttgtgacccaataaggacaagatttcagtggttctgggatgcatttgatctttatgcacacttcagctctgggtttcagttcaggggtcagcataagtaaagcttgatcagataactatgctttgcctataatcggcattcattctgctggtgacagagtcctttgctcaaaatgaggcttccatgcgtttgcagttctaaactgcttttcagagtcatgcctcagtcattgtactgaaggatgcctgtggaaatggtggactt

SEQ ID NO: 202 - DNA, 601 bp, Human
aggatgcctgtggaaatggtggacttccgtgttctttgcattgcctctcccccatccctcttacacacagctgtgacatgggcatgcacactccttcacacacacagactctccagccccctttccacttcctctttccatttggcttcatgacatttttatcagagattcaaaatctcagatgaaatccaagtcagcctgttttaccagttgtcgaaattgccggagtgcagcactgtggagaatggcagttgtaataaatgagaaataccaggtgtttgaattagctgtagattttcayattgtctcttctaaccctgcttgtgcccccgcagcctttttccatttacaactcagtaatgtttgttttcacagagattaccggaggaaatagattataaagggaaatgttggcatttatagtagtactatttcaaaataaggttcacttttcactttgtatttcattgttcattgttattttcttatccaggtcaaactggcagtttcctgttggcttgccagagtatctgatagcctgactcttaagttcatttcattttctagaatgttctttgttcccctctccagttccttccat

SEQ ID NO: 203 - DNA, 601 bp, Human
agttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaaggtaagggtgcagcagcggcctggacggagggtgtgaccgttcattcctgtggttgtaatgtgcctgagccctaatattacacgtatcagacaacagtgtagttctccattggaaaccagctatcttctggttttttttttttttttttgagacagagtctcactctgttgcccaggctggagtgcagtggcacgatcatggctcactgcaatttctgcctcccaggttcaagcatttctcattccccagcattccgagtagctgggattacaggcatgcaccaccatgcccagctaatttttgtatttttagtagagacggggtttcaccatgttgcccaggctggtctgaaactcctaacctcaggtgatttgcccgcctcggcctcccaaagtgctgggattatagccttgagccaccacatctggccg

SEQ ID NO: 204 - DNA, 601 bp, Human
cacaattactgctccaaaggtaagggtgcagcagcggcctggacggagggtgtgaccgttcattcctgtggttgtaatgtgcctgagccctaatattacacgtatcagacaacagtgtagttctccattggaaaccagctatcttctggttttttttttttttttttgagacagagtctcactctgttgcccaggctggagtgcagtggcacgatcatggctcactgcaatttctgcctcccaggttcaagcatttctcattccccagcattccgagtagctgggattacaggcatgcacyaccatgcccagctaatttttgtatttttagtagagacggggtttcaccatgttgcccaggctggtctgaaactcctaacctcaggtgatttgcccgcctcggcctcccaaagtgctgggattatagccttgagccaccacatctggccgagaccagctatcttcttgattaaaggtactgagagctattatttttccttacaagcatgtataacggctttcattcccactcttgttttggcttttcttttccgagaagacaaaatccccatcaggaagtatgccgacggcaccatcgaca

SEQ ID NO: 205 - DNA, 601 bp, Human
aaatctggaaacccagtgtacatcaacaggtgagtggctcaataaaatgggctcgaaccttacagtagaatattattcagccataaaaagggaggaaattttgatccatgtcacaacacagatgaaccttgaagacaccatgccaagtgaaacaaggccagacacaaaaggacagatagtgtatgattttatgttgtgtgaaatatatggaatgggcaaatgtatggtgacagaaagtagatttgaatttaccaggggatggggatagagtgtggaggggaatgggaattattccataatygataggttttctatttggagtgatgaaaatttttggaaatagataatgatgatagctgtaccattctgtgaatgcaattaatgccactgaattgtacccttaaaatgattaaaatggcaactttttatcttacatatattttgttttgttttaaaattttattttaacacaataaaaaatgttaaacaatttttttttcctttcaaaaaaggattagcccagtagtgtgtgggaaaggagatggaagcacagtggtgctccctggccccctcttcctgtaagattatagtgcagattttg

SEQ ID NO: 206 - DNA, 601 bp, Human
gaagctagagtttgtaaaacttactagtttctgaagtcaatattcgcagtaaatgcctttctttgactactgtctttattttgtaaatcacatagtttggtttaactagctaaaatgttgacagatgttggaaagtaaaaggttttccaatagggctaggttgtattatgggatggagtggggaaagttggcagtaatgtttgcttttgggcgtacgatttggaaatgtagttgtttaccaaaaaaaatgatgtatgggccattgtgcttcccctgttcctgccttccagataatgttctstgtcacctccctccccttgtcactgccttgatgtcatcagcattgagagctgtgcagtccctaaaagtgtgatgttgataaacaagtaaactactgagtatacttcatgaagtaatcccagttaaatgggggtgggctgagccgggagaggggttttgacagaattattttgcggtacatcaaacctaagcaacttctgacagacacaagtgtatgttgtgttggttttgaaggtaggcaggaaatttgttgatgatgtgttgacaaagatttccctgacagtaaatgtggtttcttgtg

SEQ ID NO: 207 - DNA, 601 bp, Human
ttgtaaaacttactagtttctgaagtcaatattcgcagtaaatgcctttctttgactactgtctttattttgtaaatcacatagtttggtttaactagctaaaatgttgacagatgttggaaagtaaaaggttttccaatagggctaggttgtattatgggatggagtggggaaagttggcagtaatgtttgcttttgggcgtacgatttggaaatgtagttgtttaccaaaaaaaatgatgtatgggccattgtgcttcccctgttcctgccttccagataatgttctgtgtcacctccstccccttgtcactgccttgatgtcatcagcattgagagctgtgcagtccctaaaagtgtgatgttgataaacaagtaaactactgagtatacttcatgaagtaatcccagttaaatgggggtgggctgagccgggagaggggttttgacagaattattttgcggtacatcaaacctaagcaacttctgacagacacaagtgtatgttgtgttggttttgaaggtaggcaggaaatttgttgatgatgtgttgacaaagatttccctgacagtaaatgtggtttcttgtgtttttcccttc

SEQ ID NO: 208 - DNA, 601 bp, Human
acagctgcaaccacgaggctgagaagctgggctgcagcgcctccaacttcgtctttgcaaggactatgcccgcaggtatggtatgatccagctggccccattgccaccttcctcacaacctagtggagaagatgtgttttatggacacagggtctgacacccagggccatgacccttagacccaggcctgcctgctaaataacgtgcagtcattggcaggtggcgtgtagaccagctgcccagggaacagagcccacgctctcctagtgacaccactcccagcttggtctctccatagaaygtgctgggagcagggagctgtctgcagggtccaccctccacctgctacttggtgcacatcgtgcattcctgctgtcctttgccccctcttgcgcacaaatcgggttgccccctcctgagctctcacatgtccagagatgtctccagttagttgccttgatccagagtaaacattgcccctcaagatcaactcctggagtagcctctggtcttgcttatttagtctttggctttcccttgttgttagacactgcctgtcactcgggcattcatccatctttgaaggtgggtgccttcaaag

SEQ ID NO: 209 - DNA, 601 bp, Human
taacgtgcagtcattggcaggtggcgtgtagaccagctgcccagggaacagagcccacgctctcctagtgacaccactcccagcttggtctctccatagaacgtgctgggagcagggagctgtctgcagggtccaccctccacctgctacttggtgcacatcgtgcattcctgctgtcctttgccccctcttgcgcacaaatcgggttgccccctcctgagctctcacatgtccagagatgtctccagttagttgccttgatccagagtaaacattgcccctcaagatcaactcctggagyagcctctggtcttgcttatttagtctttggctttcccttgttgttagacactgcctgtcactcgggcattcatccatctttgaaggtgggtgccttcaaagacagaacaagagctgccctgtcctttagtaggcctcaggtggtagaaagagcacggaggtgaccagagtctggggtgtggggtcctcctgggtgcagttctggcactgaagtccattgtagcgtgccttgaggcagtcgtcaggctccctgcctcagtttccttagccctcctgggagagacatagccagctaacccct

SEQ ID NO: 210 - DNA, 601 bp, Human
tcctagtgacaccactcccagcttggtctctccatagaacgtgctgggagcagggagctgtctgcagggtccaccctccacctgctacttggtgcacatcgtgcattcctgctgtcctttgccccctcttgcgcacaaatcgggttgccccctcctgagctctcacatgtccagagatgtctccagttagttgccttgatccagagtaaacattgcccctcaagatcaactcctggagtagcctctggtcttgcttatttagtctttggctttcccttgttgttagacactgcctgtcacycgggcattcatccatctttgaaggtgggtgccttcaaagacagaacaagagctgccctgtcctttagtaggcctcaggtggtagaaagagcacggaggtgaccagagtctggggtgtggggtcctcctgggtgcagttctggcactgaagtccattgtagcgtgccttgaggcagtcgtcaggctccctgcctcagtttccttagccctcctgggagagacatagccagctaacccctcaagtgccttttccggctgtaactttccatgacctttgcttatcacaactttgtttactgct

SEQ ID NO: 211 - DNA, 601 bp, Human
agggagctgtctgcagggtccaccctccacctgctacttggtgcacatcgtgcattcctgctgtcctttgccccctcttgcgcacaaatcgggttgccccctcctgagctctcacatgtccagagatgtctccagttagttgccttgatccagagtaaacattgcccctcaagatcaactcctggagtagcctctggtcttgcttatttagtctttggctttcccttgttgttagacactgcctgtcactcgggcattcatccatctttgaaggtgggtgccttcaaagacagaacaagarctgccctgtcctttagtaggcctcaggtggtagaaagagcacggaggtgaccagagtctggggtgtggggtcctcctgggtgcagttctggcactgaagtccattgtagcgtgccttgaggcagtcgtcaggctccctgcctcagtttccttagccctcctgggagagacatagccagctaacccctcaagtgccttttccggctgtaactttccatgacctttgcttatcacaactttgtttactgcttcaagaagcaaaagcaagaaaggaaccactgcaaggtcagccagccgctgg

SEQ ID NO: 212 - DNA, 601 bp, Human
ttatagaatactattctaccataaattagaaaagaaaaatgtcgtttgtggcaacctggatgaacctggaggacatgatgttaagttaaataagccagacacagaaagagaaataccacatgatctttctgataatgcggaatctaagaagttaagctcatggagagtagaatggaggttaccaggggctgagggtgagggagcagatttggggagatgttagtcaaaggatacaaaatttcagttagataggaggaataagttcaatagatatattgtacatgatgacagtaataatgaggtattcttaaaaattgctgagacaatagattttaagtgttctcaccacacacaaaaaaatgtgatgtaatacatatgttaattaggctcattcagctgttctacaatgtatgcatatttcaaaacaatatgttgtacatgataaatatacaatttttatttgtatattaaaattaattaattttaaaaaagatctccagtagtcacctggtcagcaccagatattctaatctgtttgtgatatctgaaaatcctaatacagacagcaaaagcaggatggggtgaatagaactgcaaatct

SEQ ID NO: 213 - DNA, 601 bp, Human
ttctgataatgcggaatctaagaagttaagctcatggagagtagaatggaggttaccaggggctgagggtgagggagcagatttggggagatgttagtcaaaggatacaaaatttcagttagataggaggaataagttcaatagatatattgtacatgatgacagtaataatgatgtattcttaaaaattgctgagacaatagattttaagtgttctcaccacacacaaaaaaatgtgatgtaatacatatgttaattaggctcattcagctgttctacaatgtatgcatatttcaaaacaatatgttgtacatgataaatatacaatttttatttgtatattaaaattaattaattttaaaaaagatctccagtagtcacctggtcagcaccagatattctaatctgtttgtgatatctgaaaatcctaatacagacagcaaaagcaggatggggtgaatagaactgcaaatcttgagccaacattttatgtgcctggcactgttcctgggttcaggtttttaggggtaaatggatgtttaggcagataattttgtcaattaaaatagtctgaattgttccatctagtccagttaaccta

SEQ ID NO: 214 - DNA, 601 bp, Human
taatgcggaatctaagaagttaagctcatggagagtagaatggaggttaccaggggctgagggtgagggagcagatttggggagatgttagtcaaaggatacaaaatttcagttagataggaggaataagttcaatagatatattgtacatgatgacagtaataatgatgtattcttaaaaattgctgagacaatagattttaagtgttctcaccacacacaaaaaaatgtgatgtaatacatatgttaattaggctcattcagctgttctacaatgtatgcatatttcaaaacaatatgytgtacatgataaatatacaatttttatttgtatattaaaattaattaattttaaaaaagatctccagtagtcacctggtcagcaccagatattctaatctgtttgtgatatctgaaaatcctaatacagacagcaaaagcaggatggggtgaatagaactgcaaatcttgagccaacattttatgtgcctggcactgttcctgggttcaggtttttaggggtaaatggatgtttaggcagataattttgtcaattaaaatagtctgaattgttccatctagtccagttaacctagtctca

SEQ ID NO: 215 - DNA, 601 bp, Human
gatattctaatctgtttgtgatatctgaaaatcctaatacagacagcaaaagcaggatggggtgaatagaactgcaaatcttgagccaacattttatgtgcctggcactgttcctgggttcaggtttttaggggtaaatggatgtttaggcagataattttgtcaattaaaatagtctgaattgttccatctagtccagttaacctagtctcaccagttagtctatgccacctttgcagcacccagaagcttcataatattcctgcagccttgtccagggtagtggcttgcttgctttctrtctttccccagcctccttccctcctctttttcctcccctccatctcctagaaacagatcctagtttgggggtctgtgatctgtgaaacagcaaccttggcttctggggttgagtgaactcagcttgttttggtgacatgacatgttcctgtctgcctttgctgctccatttttaaccttgtaagtgccaggatgccagtgggaaatcgggagtccttctgatagaatttttccagcagatgttatcacgtactgcagggaaattggatctgcgtgctggccttactgttgagaaattttt

SEQ ID NO: 216 - DNA, 601 bp, Human
aattttgtcaattaaaatagtctgaattgttccatctagtccagttaacctagtctcaccagttagtctatgccacctttgcagcacccagaagcttcataatattcctgcagccttgtccagggtagtggcttgcttgctttctatctttccccagcctccttccctcctctttttcctcccctccatctcctagaaacagatcctagtttgggggtctgtgatctgtgaaacagcaaccttggcttctggggttgagtgaactcagcttgttttggtgacatgacatgttcctgtctgsctttgctgctccatttttaaccttgtaagtgccaggatgccagtgggaaatcgggagtccttctgatagaatttttccagcagatgttatcacgtactgcagggaaattggatctgcgtgctggccttactgttgagaaatttttccttatgtcagacaagactctgtcctgctacagtttagtctcatttcctcttatttaatcctcagaggagatggaaggtttggaagctttcaggcaactgccttccttttaggaactccttgtgtgcctgaatactattaaattactcctcagac

SEQ ID NO: 217 - DNA, 601 bp, Human
atcatacaccagtttcctagccatttaatcatttttgttattctctggatgtgttccattttctccatgtccctgttgaaatgtgaaactcaaaaagaacacagtacagcctgaccagtagtataagtgatataaacagtgatataagggccttgggggaagaaagaaaaatctgccagctttccgttggtaatgatcacctctgagtgtttttaggaattgcaaaatgctggagcctgcatccattttgagagctacaatatcaataaaaatacttctttcttcgattaaaatacttctmattttaaaaattaaaatagctgtagtagtctttaaagagtaaccatgatcacagttttccatggcaaaataatcattgataggggacttacgattaatgtttacttgatccccagtgattccaggcccatttccacatagacatctgtatttggacgtcccagagaggtctcagattccttgtgccaaaaccaaaatcacagttgttgccctcgaaaggcctcttctctcctttgctccttagctcagtcagtggtcttgtaatccatttgttacccaagccaggaacctcacagcatcc

SEQ ID NO: 218 - DNA, 601 bp, Human
ttggacgtcccagagaggtctcagattccttgtgccaaaaccaaaatcacagttgttgccctcgaaaggcctcttctctcctttgctccttagctcagtcagtggtcttgtaatccatttgttacccaagccaggaacctcacagcatccttcactcttctttctgttcagccacccctttttcattccaacccaagcctcatggattctgcctcttaaatgtctctggaatccagccctctgtcaccaccagcaccgccacagctcagactccaggtcactcgccttggggggatggtakgagctgtcatactgtatgagcctcatcctggggccatgacttaccaagccagatcatctctgtgagtctgcctggtgtaaagacaaggatcagtgacttctttgtaggtctgaactgggtaatgcagagcatgccctggagacatggcatgtccccccaattctccaagacatgacagtgccttctcttactgccaggtccctccgtctgtcctcagcacagccatttccctggaacgcgaatctgatcagttcactgctgggcctgaaagctttcgctgactccttttaatctgcagaa

SEQ ID NO: 219 - DNA, 601 bp, Human
ctgtggaatgtgggaaattagtgtcaaatgtatgcattttcactaacagtcattaaactgcgtacaaagattatttttcttcagtctatcattgaaactattgcaccagaatatactgtactttaaaaaatgagtatatgcctcagtctgcacatatttactcttttttcaaataattgtttgtttgccgtgttctatttctgacaccatttaccttcaggaattcttactgtatgatggggagtaaacgaatatacaggtatttttttcatacttccaactgaatgtgaagaaatgaaaygagcaaattgttcacctggtgatattttatcatttcctcctctttgctgcagcaggatatgaaaacttcatccatctgatcatcgctctgcccgtcgctgtcctgttgatcgtgggagggttggtgattatgctgtacgtcttccatagaaagaggtcagtgatgtgcaaagttatgacactttctgtggctgagtggtttgatgatttgaatgtgagtgaaggtgatatttttgaagatttcaaggaaatattttatggactggaaaacctgattttcccatcaaatgttcttccagga

SEQ ID NO: 220 - DNA, 601 bp, Human
gagtgtagacaagagctgctgtagacagtaagctctccccattctgttctgataccgtgtgagagaggataaatgaaactgttgtagcgaagatgaaagtatatacaggaatgtatggaggtggggttttgttaacgtgaatttaatctttttgacagaaataacagcaggctggggaatggagtgctgtatgcctctgtgaacccggagtacttcagcgctgctgatggtaagagtccgggccaccagcactgccagcgtgcagggcaggtagatcgggagctttcaggagggttgctartttgggaaaggaaggaggtttgcattattttgagctacctttggccttggatctgtcttcattaatatttctttctttctttttttttttaatcaaagtttttagcagttcagtgaatatgtcaaaacttgtgggactgtatggggtgccccaaggaaacacaggctttagagatgaatgtggccagcgcagtaatcaatttatttaattgcttgagatgttatgctagaatgaaaacagctttttaattgttaacatctagtcagaggatatgctgcagctgacaaaacagtcctttta

SEQ ID NO: 221 - DNA, 601 bp, Human
cccagctactcgggagactgaggtgaaaggattacctgagcccaagagctgcagtgagctagaatcccaccactgcactacagcctatagagcgagactggctcttaaaatccagcaagaagatagatatgcattgtttgtatgaataatagcttctaaaaagaaaatcagtaaggaagggagtcatcccagatgatggaattgatagaacaaggcaagaccactttccccctctgtgagggtggactgtgactctacgagagaagctattctgctttgaaatgcggcactagaggttggygtgtgtagcttttgactgtgaagtgtccaggaagagaaagcatcaatacaacaaattcagattctcagggctctcatggtgacttgaattcacattttgtgtccttctagaatgctttcatgatacgtcttggtacttcattacaacaaaaacaaacttattgccacccaggtcgacaggtgggaacagtgtcaccttatttgaacttaatttattcggcctttgagaagcacttatagccagtttcctcgaggggcaacaaaatgacattgcagttcaaaagtgctttaaaaacttctt

SEQ ID NO: 222 - DNA, 601 bp, Human
acaaggcaagaccactttccccctctgtgagggtggactgtgactctacgagagaagctattctgctttgaaatgcggcactagaggttggtgtgtgtagcttttgactgtgaagtgtccaggaagagaaagcatcaatacaacaaattcagattctcagggctctcatggtgacttgaattcacattttgtgtccttctagaatgctttcatgatacgtcttggtacttcattacaacaaaaacaaacttattgccacccaggtcgacaggtgggaacagtgtcaccttatttgaacttratttattcggcctttgagaagcacttatagccagtttcctcgaggggcaacaaaatgacattgcagttcaaaagtgctttaaaaacttctttttcccaaagctataatctgcatgtcaccattctccagagtacattgaaaatcccctacaggaaagtgctgataacattgtgcacagaaaccgctcctggctggtggcactggggacgcctgcttaaagtcggagccgttgggttgaatcgagagaaaaggattgagcgtattgacttcagggacctcccagggaatgaatgtgattgg

SEQ ID NO: 223 - DNA, 601 bp, Human
taatagagacagtgttttgccatgttgcccaggctggtctcaaattcctgggctcaagcgatcctcccaacttggcctacgattacaggcatgagccaccgcacacggcccatttattttcttaaaccagatcgaatctaaacagaaacagaaactggagaagaaatcctattcaggcttggtatctactgtgcattcctcccaaatctctacccattggtcaaggtccctgagttcacagagcccaggccagagccctggaaacgcctctgcccgtccgctgcctaattgcctgtccacrctgggcaccaccgggtctctccctcagtctcagagctcagttgcttctgcacctcatcagggatccagccatcaaagccaaggctgggggacacttggactagagtaatcctaccaataatgcagttcagctttgtaaccgcaaattttctagtagccgtattttttaaaagtaaaaagaaacagatcaaatgcattttaatagttttttagttccaataatacgtttcgtgtaacccagtatatccaaaatatccattttaacatggagtcagtattaaagttacctaaatatttcact

SEQ ID NO: 224 - DNA, 601 bp, Human
gttttgccatgttgcccaggctggtctcaaattcctgggctcaagcgatcctcccaacttggcctacgattacaggcatgagccaccgcacacggcccatttattttcttaaaccagatcgaatctaaacagaaacagaaactggagaagaaatcctattcaggcttggtatctactgtgcattcctcccaaatctctacccattggtcaaggtccctgagttcacagagcccaggccagagccctggaaacgcctctgcccgtccgctgcctaattgcctgtccacgctgggcaccaccrggtctctccctcagtctcagagctcagttgcttctgcacctcatcagggatccagccatcaaagccaaggctgggggacacttggactagagtaatcctaccaataatgcagttcagctttgtaaccgcaaattttctagtagccgtattttttaaaagtaaaaagaaacagatcaaatgcattttaatagttttttagttccaataatacgtttcgtgtaacccagtatatccaaaatatccattttaacatggagtcagtattaaagttacctaaatatttcactttttttttttttt

SEQ ID NO: 225 - DNA, 601 bp, Human
cgcacacggcccatttattttcttaaaccagatcgaatctaaacagaaacagaaactggagaagaaatcctattcaggcttggtatctactgtgcattcctcccaaatctctacccattggtcaaggtccctgagttcacagagcccaggccagagccctggaaacgcctctgcccgtccgctgcctaattgcctgtccacgctgggcaccaccgggtctctccctcagtctcagagctcagttgcttctgcacctcatcagggatccagccatcaaagccaaggctgggggacacttggrctagagtaatcctaccaataatgcagttcagctttgtaaccgcaaattttctagtagccgtattttttaaaagtaaaaagaaacagatcaaatgcattttaatagttttttagttccaataatacgtttcgtgtaacccagtatatccaaaatatccattttaacatggagtcagtattaaagttacctaaatatttcacttttttttttttttttgtctaatctttgaaatcccatgtgcatgtctcaaattggactggccacatggaatgctcaggagtcccatgtagggaccagctg

SEQ ID NO: 226 - DNA, 601 bp, Human
gagtcccatgtagggaccagctgccatgttagatagcccaggcatagcatctgtgttgagggccctgacacctcttttggattcatccaagaagtaggaccttacgtgcaccatcatcacctctcatatgtgactctggcctttttcccgacccagcataagaactcttccctctccctactactctcctcctttttacatttgcgttttaatctgttggtgaagatgggtaaaatcctgcttgaccatttcattcagtttctcaatcccctgtggttaatttgtttttttcaaaaatgtrtttttatgtgatgaaaagaaatttttaaaaaccaactgctttctttcctatactagacttccttgctttgttctggtccttctatctgttagtatcctcaaattatcttgaaatcctcagagatctgaaatactagtactgactgtacagttttcttactcaaatctatagcatgtggaaagttgacagcaagccatgccatcgcctcctggtattctctgtgggtttaaggaagcagcatcttatattctttggcttagagttcccccaaagcacgttctgtctaagggcttgtttctg

SEQ ID NO: 227 - DNA, 601 bp, Human
cgcctcctggtattctctgtgggtttaaggaagcagcatcttatattctttggcttagagttcccccaaagcacgttctgtctaagggcttgtttctgtacctgctttaattacggtttcttctccagtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgaraggattgagtttctcaacgaagcttctgtgatgaaggagttcaattgtcaccatgtggtaagagaaagttcctgaaaagccaaaatgcagcacagggagagggtatcacacaagcctcccagtatgttcttggctgcatgtacccgtgggtttggtgtcttgcctttgccttctggatagttaccccattacctcactgctaccttcagacccctgtgctcagaccaggccgcagcaccacagagacagttccagacaacacaggcaccagcaagggccaccctgaccctctgagtcttt

SEQ ID NO: 228 - DNA, 601 bp, Human
ctccctccccgaagctttcctgccccactccagtagctatctcctctgctaacttctcgatgcgcttgactcacatcctcgtatgtgttctctctcgttatgttgtgttgtgctgttgttggagtgtgtcccccctccaccccgttgtgtttagcttttcatctcagtccaagtgtgtggctcagggccgcatttgtggcaggcactctgtcaataaatgtatgttacagttcaaggttaagctgcctggattcttgcccttgcatctgggaagttgctgggtgatttcccacccagctcygtgcgcaagatgtgcactcattcataaaccccctccccacacacagtccccttccccggcattgttggcggtccttgtctttgccactgggaatctggtttcctcagactctacgtccacgtttcaggattgatccagagtcagtgtcctgcttacgcttttgaatgaatgatcccacctcagctgcaggatttctgcttagtttcctaaaaatttcactttgggttatgagcttccaattctaaacctgctaaagtcctatgcaatttttcattaaaagtcaccgtggtgtctcccccc

SEQ ID NO: 229 - DNA, 601 bp, Human
attaaaagtcaccgtggtgtctcccccctctgtagtattaacccacaggccagctttttaacatatgcgggcatgacttttgagtaattaattctacaaataaactgggagataaatgctgagacataaagccagcaagaactgagttttcatttggttgcctccgtgggtctgaagtctttgacccttactttgctgcttactgggtaagcagtgtgtctgcttttattccttagaagcagtgacttccccttctcggcccctttggaaattcttttgctgttcttcatttgggcttaatttttttttttttttaatgttctttgaatcggcaacttaatcatctcccaagtgacagtttcttaattttagttccaaacacctgttcacatatgacttcatgtatttgcagcacatggtgtttggggccaagtgtggactggggcttcaagcaggatggtttacaaaactcccaccctctgttctgccaagcattggtccccagcacccctgggtgttagtgcctcttcctggttcactcactcactttctctggccctctctgtgtctctctcactctctttctttcgagatggagttt

SEQ ID NO: 230 - DNA, 601 bp, Human
aactgggagataaatgctgagacataaagccagcaagaactgagttttcatttggttgcctccgtgggtctgaagtctttgacccttactttgctgcttactgggtaagcagtgtgtctgcttttattccttagaagcagtgacttccccttctcggcccctttggaaattcttttgctgttcttcatttgggcttaatttttttttttttttaatgttctttgaatcggcaacttaatcatctcccaagtgacagtttcttaattttagttccaaacacctgttcacatatgacttcatktatttgcagcacatggtgtttggggccaagtgtggactggggcttcaagcaggatggtttacaaaactcccaccctctgttctgccaagcattggtccccagcacccctgggtgttagtgcctcttcctggttcactcactcactttctctggccctctctgtgtctctctcactctctttctttcgagatggagttttgctctgttgcccaggctggggtgcagtggcatgatctcagctcactgcaacctccaccacctgggttcaagcgattctcctgcctcagtctcccaagtagc

SEQ ID NO: 231 - DNA, 601 bp, Human
tcttttgctgttcttcatttgggcttaatttttttttttttttaatgttctttgaatcggcaacttaatcatctcccaagtgacagtttcttaattttagttccaaacacctgttcacatatgacttcatgtatttgcagcacatggtgtttggggccaagtgtggactggggcttcaagcaggatggtttacaaaactcccaccctctgttctgccaagcattggtccccagcacccctgggtgttagtgcctcttcctggttcactcactcactttctctggccctctctgtgtctctstcactctctttctttcgagatggagttttgctctgttgcccaggctggggtgcagtggcatgatctcagctcactgcaacctccaccacctgggttcaagcgattctcctgcctcagtctcccaagtagctgggattacaggtgtgtaccaccacgcccacctaatttttgtatttttagtagagacggggtttcaccatgttggccaggctggtcttgaactcctgacctcaggtgatccacccacctcagcctcccaaagtgctgggattacaggtgtgagccgctgcacctggccct

SEQ ID NO: 232 - DNA, 601 bp, Human
tgtttggggccaagtgtggactggggcttcaagcaggatggtttacaaaactcccaccctctgttctgccaagcattggtccccagcacccctgggtgttagtgcctcttcctggttcactcactcactttctctggccctctctgtgtctctctcactctctttctttcgagatggagttttgctctgttgcccaggctggggtgcagtggcatgatctcagctcactgcaacctccaccacctgggttcaagcgattctcctgcctcagtctcccaagtagctgggattacaggtgtgyaccaccacgcccacctaatttttgtatttttagtagagacggggtttcaccatgttggccaggctggtcttgaactcctgacctcaggtgatccacccacctcagcctcccaaagtgctgggattacaggtgtgagccgctgcacctggcccttggttcactttaatacacaaaacagcatgaaggagaaaagcttgatgaaataggtgactggagatctggcagagtatttcttgccagcatcgattgaggcacctctgaaaagtccaaaactcactcccttcctctccagtttcaggc

SEQ ID NO: 233 - DNA, 601 bp, Human
gccaagtgtggactggggcttcaagcaggatggtttacaaaactcccaccctctgttctgccaagcattggtccccagcacccctgggtgttagtgcctcttcctggttcactcactcactttctctggccctctctgtgtctctctcactctctttctttcgagatggagttttgctctgttgcccaggctggggtgcagtggcatgatctcagctcactgcaacctccaccacctgggttcaagcgattctcctgcctcagtctcccaagtagctgggattacaggtgtgtaccaccaygcccacctaatttttgtatttttagtagagacggggtttcaccatgttggccaggctggtcttgaactcctgacctcaggtgatccacccacctcagcctcccaaagtgctgggattacaggtgtgagccgctgcacctggcccttggttcactttaatacacaaaacagcatgaaggagaaaagcttgatgaaataggtgactggagatctggcagagtatttcttgccagcatcgattgaggcacctctgaaaagtccaaaactcactcccttcctctccagtttcaggcacagaata

SEQ ID NO: 234 - DNA, 601 bp, Human
tgtgtctctctcactctctttctttcgagatggagttttgctctgttgcccaggctggggtgcagtggcatgatctcagctcactgcaacctccaccacctgggttcaagcgattctcctgcctcagtctcccaagtagctgggattacaggtgtgtaccaccacgcccacctaatttttgtatttttagtagagacggggtttcaccatgttggccaggctggtcttgaactcctgacctcaggtgatccacccacctcagcctcccaaagtgctgggattacaggtgtgagccgctgcrcctggcccttggttcactttaatacacaaaacagcatgaaggagaaaagcttgatgaaataggtgactggagatctggcagagtatttcttgccagcatcgattgaggcacctctgaaaagtccaaaactcactcccttcctctccagtttcaggcacagaataaaaattcagaacacatggccttggtcctggctctgtggctggctgcctgtggtcctcagacagctgctgcaggttcctgggcctcagtgtcctcaatatgaaataagagggtgggacaagattactgaagtccctt

SEQ ID NO: 235 - DNA, 601 bp, Human
tgtgagatgctttgtggtcaagaaaaccaaggtgtagagtctgttgcacttgtatatgcaaaagtaaaaggtaacattaaaattagggactagtgattgttttaggatggagagacttgggcatgtgttttatataaaacttttttctaaatggatgtattatttaagggtaattctttttaattccaaagccagcacgttgctgtcctctgcaaagaggaatgcttatccctgttacttattcctggtttcctccaagactagtttcagctggacttcagttgccaaggacttgtcttcygtaatgcccacagaaaataataatgccacattgtaaggtgaaaacagtaatcctggtatttttgtattttagaagaaggttgaagggaaagaaaaggattaaataatttataacgatgcttttatgggaaataaaatataccatgtccatttggaaacacatttgcttacttccacacagcctttgtaacgtgctctccttcctcttacctgtacttcggtgatggaaataaaaggaacatataaacaaataggaatttgagtaactgagaatccttactaccaaaaatggcttgtttca

SEQ ID NO: 236 - DNA, 601 bp, Human
ccctggagaggttttctagtgtgtcccttgagtgcacggactccttcttgggaatgatgtgattgtctccagttgatggtcacaaacctggcacggtcggtcccaatgctgatagctcatggacatggtggttcagatactgggcacggtccctgaggctggctctccagacgtttgaggcatttcttggtagaacacctcttagcattggttacagaaataattaagacaatgtcttcaggagattttgacttgggaataaaactcactgtccaaccttgcattcatccctccaattttyctagcttttaaggagcattgctccccttccagggacccacattggtttctaagaggcaagctgccctaatgacgaagcctctgcacggagcaggagcagtggcaggagctggcatggcagtcccttaggtgagggacgatcactgctcactgggtttcacggctggggctggccagcctccaagctctcgaccactctctcacaacacttactgtcctgctcttagctcaccagcctactggttagactcccttgttgccaccacccactgtcacaccagaaaaaagggttggattgaat

SEQ ID NO: 237 - DNA, 601 bp, Human
gggaatgatgtgattgtctccagttgatggtcacaaacctggcacggtcggtcccaatgctgatagctcatggacatggtggttcagatactgggcacggtccctgaggctggctctccagacgtttgaggcatttcttggtagaacacctcttagcattggttacagaaataattaagacaatgtcttcaggagattttgacttgggaataaaactcactgtccaaccttgcattcatccctccaattttcctagcttttaaggagcattgctccccttccagggacccacattggtttmtaagaggcaagctgccctaatgacgaagcctctgcacggagcaggagcagtggcaggagctggcatggcagtcccttaggtgagggacgatcactgctcactgggtttcacggctggggctggccagcctccaagctctcgaccactctctcacaacacttactgtcctgctcttagctcaccagcctactggttagactcccttgttgccaccacccactgtcacaccagaaaaaagggttggattgaatttctgagcaatggttaaaacccacttcagcctttaggtttgtgttttta

SEQ ID NO: 238 - DNA, 601 bp, Human
ttctttttactctgtaggagctagaggtattgaaatggaaccatatcccagagcccacatccctccgtcatcagagttcctcattcaggatccaccagtgtgtccctaggtttggcacgttgagacgtcctcacgtttggtgctctgtgaagctgggcagccctcagagaggcaaagaagtcccaagaggccgtcctgcctcagggctctcaggaaagagccgcccgcgtccctggctgggcttccttggtgcacccagctcatttctccttccctctctgtagaactcacattgtccccrtggaaatgccagccagctcccctttcccagtgcaggggggagccaggtgggcctgaggtgggccagttctgccgctaatgggtgagagacttgggccaggtgccttacatccgggagcctcagtttcctcacctcggaaatagggtgataatgtaacagaccccatggggttatgagaaggacttggtgcaggaaagcagcagcacgtgcctggcacagggcagggcctctccagatggcagttcctgtctgtgtcttattcccaccctccgggcacatggggggaactcagtttctccc

SEQ ID NO: 239 - DNA, 601 bp, Human
cctcagagaggcaaagaagtcccaagaggccgtcctgcctcagggctctcaggaaagagccgcccgcgtccctggctgggcttccttggtgcacccagctcatttctccttccctctctgtagaactcacattgtccccgtggaaatgccagccagctcccctttcccagtgcaggggggagccaggtgggcctgaggtgggccagttctgccgctaatgggtgagagacttgggccaggtgccttacatccgggagcctcagtttcctcacctcggaaatagggtgataatgtaacagaccccatggggttatgagaaggacttggtgcaggaaagcagcagcacgtgcctggcacagggcagggcctctccagatggcagttcctgtctgtgtcttattcccaccctccgggcacatggggggaactcagtttctccccactgcgcgtcaccctgggagaggtgttttttgtgccaattgccattttaaatccaaatcagcagggatcatgtttgctgttcaaccatgtggcatatttatagtgattttttttgtaatcatggtttttctttctggaatttcaagtttttcatttgtgc

SEQ ID NO: 240 - DNA, 601 bp, Human
tttcccccttattaagcagtgaaattatttacttttctccagtggtggggcagtgctaccaagttaagtaagcatctgtactctcctgtttatttggtcaggttttaaaaccatgtgtaaatgaccagtggtctctgcagtactatatattttcttaaattgtgggactctaatttttacaccgcttccttttttcttatttttattttcaagacaggttctcactctgtcacccaagctggagtgcagtgttgtgatcatggctcactgcagcctcaacctccagggctcaagtgattcytccaccttagcctcccaagtacctaggaacacaggcgcacaccaccactcacaactgactaatttttaaaattttttatacagacagggtcttgctgtgttgcccaggctgatcttgaattcctgggcacaggcgatcttcctgtcgtggcctcccaaagtgctgggattacaggcgttgagtcactgcgctcagcctgcctctcatttaaatgcaataagggcattaacttcctaagggaatcaaattgtaaatatattaaaagtggagattgcttggtatttgctcatcatgtgatta

SEQ ID NO: 241 - DNA, 601 bp, Human
cttttctccagtggtggggcagtgctaccaagttaagtaagcatctgtactctcctgtttatttggtcaggttttaaaaccatgtgtaaatgaccagtggtctctgcagtactatatattttcttaaattgtgggactctaatttttacaccgcttccttttttcttatttttattttcaagacaggttctcactctgtcacccaagctggagtgcagtgttgtgatcatggctcactgcagcctcaacctccagggctcaagtgattcttccaccttagcctcccaagtacctaggaacrcaggcgcacaccaccactcacaactgactaatttttaaaattttttatacagacagggtcttgctgtgttgcccaggctgatcttgaattcctgggcacaggcgatcttcctgtcgtggcctcccaaagtgctgggattacaggcgttgagtcactgcgctcagcctgcctctcatttaaatgcaataagggcattaacttcctaagggaatcaaattgtaaatatattaaaagtggagattgcttggtatttgctcatcatgtgattaatcatcccttactgtctccaccttataaaat

SEQ ID NO: 242 - DNA, 601 bp, Human
ggaagcaaaacgtctcccttaatcataaacagtgtctaccagtggaagcccatcgaccgagggatcagaggcctctcagtagtattgtttattgcagttccttggcaacattgcagagaggcagtcaggttctgaaatacaactgaggttattggcaggctgaggccctggcacaggcaccttctagaatatcagctagtgtcttggctttcctctggggggatcccgttgctgttgtgttacagaaatggtagttgtttactccaacagtctggatgaccgcatagaggaactatttcartagtgactgacatcattttttttttaacctcgtaaacctttcacagttcaggggccttggatcttattttgaagacaggtgcaaattggaaatagcatttgaatatgacccggcaaagcatgattgcttcttaagctcaagtatgagatctgttttgcaatcagcttgtccaagatggttatctcttcactgtcaaatcaaagtgctctgcatggtgtttagagattgggatggtgaggagagagcaagcctgggtatgtgcatgcatctgtttattctaggcttcgtgcctccaggagc

SEQ ID NO: 243 - DNA, 601 bp, Human
taactactgtgaaccaatacaaaaagatatgtataaacatgaataggcgtttggtattcattccatgaaatgctcaggcattgacagcgcttcaggttttgtttgctttttaacacaggctttgaggatagcacaggtcaggaaggctagggcgttggagcaggtttctcagcggtccaggctctaaactaaagctgtccctctcaaaagaatggaaatgatttcagattgtattcagcagcacgaagcaatgattcctaaatagttaaaaatctagaaagaaacactaagaattgtattkggctttgtagaagagaccccagaattttaggatttgggatgtatccctgcagtcaggcccagtccccagtgcacctgcagatctttgacagctgctggttgagcttctgctaagaggtttccttccagggactccatgttcactgcctcacaaaggcaggccagcctcatgctttagacatccttgctcttaacaaatctttcgtgttctgctacgtcagcctctgtgtgacacccattggaccttctctctgtagcacaattgcataccttgctctgttcttgataagataggtctagg

SEQ ID NO: 244 - DNA, 601 bp, Human
tcaaaagaatggaaatgatttcagattgtattcagcagcacgaagcaatgattcctaaatagttaaaaatctagaaagaaacactaagaattgtattgggctttgtagaagagaccccagaattttaggatttgggatgtatccctgcagtcaggcccagtccccagtgcacctgcagatctttgacagctgctggttgagcttctgctaagaggtttccttccagggactccatgttcactgcctcacaaaggcaggccagcctcatgctttagacatccttgctcttaacaaatctttygtgttctgctacgtcagcctctgtgtgacacccattggaccttctctctgtagcacaattgcataccttgctctgttcttgataagataggtctaggagtcatcgaagaggtgtgtctgttctagccagaacacctccaagtttcctgctgtcttccaggacttcattcccaggcccttgggcactgtggctgctctccctgcagctccctgtagcaccatgtccctctgaaatgacaagggtgccctctaggcatggaggaaaccagacgaaggactggggagctgcaccccacagcct

SEQ ID NO: 245 - DNA, 601 bp, Human
tgaaatggctcctgtggcaactggtattgtgtagagatggttcagtgtccacaccttgcagttgtcacattaagctgtgaaggacgactgactctagcactcagtggtcctcagtggcaggtgatgttgacctcagacaagagttgctcaggagataggctttgcagttcacctcgacaagcgtttgtggagagctaggtctgctacctcctgtatcgttgcctgtgggtgatggtaaggctcttgggggtgtggaagatgcggggatgatgatgatgacgatgatgacgatgacgacgaygacagcgtcgtcgtcgtcctggtcctggaaggataaagtcttgtggagaagaggaggcaattctgacagtttggggttgcatcatcttcttcacagaagagatgaagttgtgtaggcaccctaagtatggattgtcacaaaaagagcactaggaagcggggcggggcggggcaggggtggggggttcctggcagtgggaatgctgggcaggcatggcagtagggagcacctgctgcaggtggggttggtgaggtttcctcgtgggacttaggctgcagagagatcaagacaggcctcagc

SEQ ID NO: 246 - DNA, 601 bp, Human
gctgtgcttgaagttcttgttagccggagtatacagctgcattgagcaagatgttgtaaccaaaggagaggtggtggtgggccaggcaagcaggatcctgcacactcagggagctctgagggacggaaggagggtgccagaccttggacagatgtgagcctgggtggacagttcgcagtgggactccgaggaggccaagggcatgggtgacagcaggcagactgctcgggtggaatgggcatcagctgcagggaagccgggggaagaacagggcacaaatcagagttcagtgtgagacgcrgtgagtttgtgggtagcccagtaactgggaacttggaatggagcagttgggccgggagggccagggtgggagccgtgccgtgagaactggctgcctgcaagccgctgacacagccaggaagggcacgtggggcaagaggagaagtgggtctgggagggagccacatcctcaggccatttcccagaccagcctgcagtcagcaaaagcagagagctagtcatttcttcttattttatttttaattttttgttgttggagagctagtcatttcttgtaccaagctgcatttcagatgtgtgg

SEQ ID NO: 247 - DNA, 601 bp, Human
ctcagggagctctgagggacggaaggagggtgccagaccttggacagatgtgagcctgggtggacagttcgcagtgggactccgaggaggccaagggcatgggtgacagcaggcagactgctcgggtggaatgggcatcagctgcagggaagccgggggaagaacagggcacaaatcagagttcagtgtgagacgcagtgagtttgtgggtagcccagtaactgggaacttggaatggagcagttgggccgggagggccagggtgggagccgtgccgtgagaactggctgcctgcaagccrctgacacagccaggaagggcacgtggggcaagaggagaagtgggtctgggagggagccacatcctcaggccatttcccagaccagcctgcagtcagcaaaagcagagagctagtcatttcttcttattttatttttaattttttgttgttggagagctagtcatttcttgtaccaagctgcatttcagatgtgtgggtactactgccactggcatctgaggcatgctgcctgtatggctgggctggttgtggaaggcagagcttcccgcacaaagctgatggagagccccttctcccctg

SEQ ID NO: 248 - DNA, 601 bp, Human
tgccactggcatctgaggcatgctgcctgtatggctgggctggttgtggaaggcagagcttcccgcacaaagctgatggagagccccttctcccctgggcccaggcctctctaaactgcacttttggcctctgggtgtcttgtacaacatgaagacgacagcatttcttggtcacttgtaattaaaaaggaccttgggttggtctgtcctctgattgctaagattctatttctgtctaacatctacttttagtatcaatttgtacaaaaatctttgattcaccgaaagtagctgaagcagygaataaaacgttctcatacagtcaggagcactgtgggcttgggcacaaggtcaaggtcccaagagctcttggttggaaatctcctgccccaggtttttccatgtggcttgaccagcacctgcagcccaggacaggtccagctagaatccctgctccccaccctgctcccgcccctacttggtgatgagtagcctattttactccaccaaagtgaaccacatggaaaggcacacaggtcagggagaatttgtgaattacggaatttgccctgggagggcacatttgttttgcagattccag

SEQ ID NO: 249 - DNA, 601 bp, Human
cagagcttcccgcacaaagctgatggagagccccttctcccctgggcccaggcctctctaaactgcacttttggcctctgggtgtcttgtacaacatgaagacgacagcatttcttggtcacttgtaattaaaaaggaccttgggttggtctgtcctctgattgctaagattctatttctgtctaacatctacttttagtatcaatttgtacaaaaatctttgattcaccgaaagtagctgaagcagcgaataaaacgttctcatacagtcaggagcactgtgggcttgggcacaaggtcwaggtcccaagagctcttggttggaaatctcctgccccaggtttttccatgtggcttgaccagcacctgcagcccaggacaggtccagctagaatccctgctccccaccctgctcccgcccctacttggtgatgagtagcctattttactccaccaaagtgaaccacatggaaaggcacacaggtcagggagaatttgtgaattacggaatttgccctgggagggcacatttgttttgcagattccagcattgtcttttttaacattctgtctgaaagttgtgtgtgtactctctgttttg

SEQ ID NO: 250 - DNA, 601 bp, Human
ggcagcattgttcagtccatccctttccaagctcctcacagtttttttctccctgtaggtccttcggggtcgtcctctgggagatcgccacactggccgagcagccctaccagggcttgtccaacgagcaagtccttcgcttcgtcatggagggcggccttctggacaagccagacaactgtcctgacatgctgtacgtacttcctgggccctccgtgctcttctgagttctcttctcaaatacctgttttcttgggtcacaggagattaggagattaaagccattctctctggtcctgcrcctcccttgccaggcgtggctaagaggtttgtccttgtggaaggagctgagtgggttggtcgacctgtgcttttccgtgggtaccttaattctaccccatattccgtaatgctttcgttccgatttgcagttcacactgtagtttctcaggccaaatgtctctgtgaaatgtttggccagagtaatccatccttactcatcctctccatgtgaggtttttgtttctttttaaagaaggctacaacacaacacatactactctgaagtcgaattcaagagccccgcgccccacctgtggca

SEQ ID NO: 251 - DNA, 601 bp, Human
aggcatgagccatcgcacctggcaaccccacttattttgaaaaaacactttgcagcttttagtcctaagttttgtcagatgacgagagagagtttgtgatgcctcacagtgttggtgaggcctctctgctcagcgccccctggagaagccccccttttggtggaggacttgctctgtgtccgtggacggtgctgttttgtggctcagtggaggtcagagctgctggagcagggaggccttgttgtccttcctggaatgagtttgaggagggggtgaaggtgttccagttcagtcatcaggygcacaacaggtacaggttgggagcagtggccttgcttttgacatgcactttaaggcaggcttcagagattgatctggatctccatagctgaacaggaaggtgggctcccactagtatctcaagaccaattcaggagatttccagaaatgcttttcaggacaggtttggcttcattttggaaaggatcctgaggaattgctgggctgttatgtctgcatgaaggcacccagctcctatctctcacccatccacccccctggagccagcacagactcaggctgggcccacagtggcgggata

SEQ ID NO: 252 - DNA, 601 bp, Human
tgaagtatcctctcatgttcacaagtcccacccgtactcaagtgaggggattatatgggatatttacaccaggggcaacgatcttggggggcatcttagaattccatagtctcagaaatcattgtccctaatcaaacaatcaaggtgctatttttgtttcaaagcactttgagtgttgctacaaatactgaatccctaagctccttgtaaatggccggccagcggagggcatggggtggggaagactggatacacacccctgtgctctgggagtacgttggctgggcggcatgctcattarctgctgcttccgaacataggttcagctgaagtgtatcccaggcagtggacacttcgtgtggaattcagaaaggtggcgcaggaaggataccagggaaagccagagtgaaggcatcacccttgcacagctagcacatgtgggggctcccattgtcccatcaaggcagggccagaaccagaaagtcggctggtgccctgggcctgggccagtgatgggaggctcctcttctctgagggtggcacctacagatgcagtggcactgggtttcctggagccctcatcaaggaaacttcccagcat

SEQ ID NO: 253 - DNA, 601 bp, Human
ttttagccatttacatgaaaaccattcttagctcatagaccttggaaaactaggcagcaggccagattttacccacaggtacatagtttgcctgctgtgccctagagtaaaagatccaggacctgagcagaaggcacgacgtcctttctgaccaaacctcagaagtcacactgaggctctcaccttctccttcaggttacaccatgtgagagtcaatcacgtggggatgtgagctccaggacacaggggagaggaccactggggatccgggagcctggctaccccccagtaccccaccaaaacacacacacacacacacacacacacacacacacactgcccctcacaggtgaccatctgctccacactttgagcagcgcagccactgttttcttgccagccattatgagaaaaatcatgctttcaagtctgaatataagccatggagtaagaggtctgatgaccactgaatctgcataaaggtacagtgctagaatctaggctaatactagaactggtggtattttagcaagcttagaaacagcccatgaaagcaggtgtgagttctgcttctgtggtttagggtgggtgagggagagcg

SEQ ID NO: 254 - DNA, 601 bp, Human
cagcccctgccatgggaaacgcagggcacttcctgttctcagcatagagtgacaaggaaatttactcagagcggttactctgacattcaatgtttagttcaggaggcatttctgctttgccatcgagaatttttctcccttctaagaaaatgttttctcctgagaaaatttttctcccttccaagaaaagagtagaatgaaaggaggcaacttggtttcatagggagtgtcatgttgtccttctgagtttactgatgagcttacctgagaaaggagggttctagcatgggagttctgttgytacaagacatgaaagaatggcctccgtttatcccggagaggagagtccctgagcccttgggagttgccttgaaacctctgccgggtcccaggtgagaaagtgtgtgagttgtgtggttctgagatctgaacaggcaccatctggtgacactaggggctgaaggagctcggtggctgcaggtggactggagctcaccatcaggaagtagccagattctcacccctcagtgtcaccgagtgttctggctttagaggaaggactccgtggtccccaagccacaaggtgtcgaggtctgagtct

SEQ ID NO: 255 - DNA, 601 bp, Human
ttctaagaaaatgttttctcctgagaaaatttttctcccttccaagaaaagagtagaatgaaaggaggcaacttggtttcatagggagtgtcatgttgtccttctgagtttactgatgagcttacctgagaaaggagggttctagcatgggagttctgttgctacaagacatgaaagaatggcctccgtttatcccggagaggagagtccctgagcccttgggagttgccttgaaacctctgccgggtcccaggtgagaaagtgtgtgagttgtgtggttctgagatctgaacaggcaccrtctggtgacactaggggctgaaggagctcggtggctgcaggtggactggagctcaccatcaggaagtagccagattctcacccctcagtgtcaccgagtgttctggctttagaggaaggactccgtggtccccaagccacaaggtgtcgaggtctgagtctcaacgccatgactcagtgtgaattaacttagcaggtatcacaacatcagatttgggttgtggttccctgctgggtctgtactttagattgatgacaaagcccgtcctcagccttatttcagcccagatctcggtattta

SEQ ID NO: 256 - DNA, 601 bp, Human
actcagtgtgaattaacttagcaggtatcacaacatcagatttgggttgtggttccctgctgggtctgtactttagattgatgacaaagcccgtcctcagccttatttcagcccagatctcggtatttatgccacagatactgttgagctcctctgggtgcgtgctgaccctgaggtcacacagatgagccaggagtggccctggctttcaggaaacgtagtgacgtaaaaggtcccggctgctgcgggataagggccagggcagaggtgtgaacgcagccgtggaagacttgggccaggragccatttgttctgctgctaacacttccacagctccacgtgtccagactgttgccagagacgtctttggtctacaggattcaggagggaatctgaactttagcctggagcattatcaactcatagatgagtctgaaacaaacttagtgaaatctgatgttttttgtagttttccagtacagtttttcccatcgctggaatcctggtttggttctgcgggaatcgagtgcttgagtgggacccagacagacaggaagggcgctcctgctcagttagccccagtaagctcactgaggcacac

SEQ ID NO: 257 - DNA, 601 bp, Human
atttgggttgtggttccctgctgggtctgtactttagattgatgacaaagcccgtcctcagccttatttcagcccagatctcggtatttatgccacagatactgttgagctcctctgggtgcgtgctgaccctgaggtcacacagatgagccaggagtggccctggctttcaggaaacgtagtgacgtaaaaggtcccggctgctgcgggataagggccagggcagaggtgtgaacgcagccgtggaagacttgggccaggaagccatttgttctgctgctaacacttccacagctccacrtgtccagactgttgccagagacgtctttggtctacaggattcaggagggaatctgaactttagcctggagcattatcaactcatagatgagtctgaaacaaacttagtgaaatctgatgttttttgtagttttccagtacagtttttcccatcgctggaatcctggtttggttctgcgggaatcgagtgcttgagtgggacccagacagacaggaagggcgctcctgctcagttagccccagtaagctcactgaggcacacaggccccatgtccacagccgctcctggctgaggcgtggt

SEQ ID NO: 258 - DNA, 601 bp, Human
ggacagttaggtgagggagggtctcctggtggccccagggttactcttatttaggttgagaaaaattcctttttccaggatcgttggtgatcaaagtgtagtcattctgttgcgcagagaactccatcccagctccaccctcatgaattttgtaatcttggacaaattatttagtatcttagtgcttctgttccctcatctgtaacatgggggtatattatagtcagtagcacctgcttcacaaactcgtgaggacttcagcagttcacacacataactgcctcgctgcctggcacctagygtgcacatggcattctaccgtggggtagacttttaaaattctggctacagagatacttttccataaaagtggccacatggaactctccaaatctaagaagcatactgtgggggccttcatattttgtctaattcttttctccccagaacaggaacctgcacccttccttcttttaaagggcgacgtggtaaataaacatttttagacttgcaggccacagtctctgtcctaatgtcctcagctggtagttgtagctggaaagcagctgcagcccacatggaaatgagggagcgtggcccc

SEQ ID NO: 259 - DNA, 601 bp, Human
gaacaggaacctgcacccttccttcttttaaagggcgacgtggtaaataaacatttttagacttgcaggccacagtctctgtcctaatgtcctcagctggtagttgtagctggaaagcagctgcagcccacatggaaatgagggagcgtggccccatgccagtgcagctgatgtagaggcgggcagccccgggttaggccctgtggagacgcaggcccccgggctctagaacgctgaattctagtgaattctggatggctctccctcacacccaggcccaccctccctcaaggttgcaccwtctccacctgaaggaagctgccaggtggccataggagcccttctcttggcaggccagcttccaggcccagtggcttctcttacatcaggggcctccccttggaatgttccctgaaggccagacacgggcaggtagtctgtggtcaagcagccaccctgacaggaggctagatgccactgggtgtgctttgagtttcctagatgtggagagttctgtgtggccacttttatggaaaagcatctctttagccagaattttaaaataaagaggataacttcctggtgagaacagacgtggaaa

SEQ ID NO: 260 - DNA, 601 bp, Human
ttttaaaataaagaggataacttcctggtgagaacagacgtggaaaggaaggcactttggtttcacgctcatgtaagagagggctgttggcggtcactcctcagaactatggccagccctggatggtagccagctgctttttgccccaaaagtctgtttagctgggtctctgcattctggaagcttgtcaaagcccgggcctttcctgggtcagggcagccggctttccttgtccacgtgtggccggctgttttcttggggagccccggccacagccggcaggactccctttgctccatgygactctgagggcctcacaggtatttgcagcccaggtgctgtcggagcccagccgatgctaccgacacacagcacaagcgtcatcctgttctgcctgtcccttgcgtgtggaggggactcgtgcccagggctctccttgctggcttgttggaatctggcttcaggtctacacggggcctctcgtttggtccagaacagcctggctcatcggctggggcttgcttgtgcagggctggagcgagcacgtgctagatggagacagcagactcggagtgtgcatttcttcgtgttgcaagcctgg

SEQ ID NO: 261 - DNA, 601 bp, Human
gtttcacgctcatgtaagagagggctgttggcggtcactcctcagaactatggccagccctggatggtagccagctgctttttgccccaaaagtctgtttagctgggtctctgcattctggaagcttgtcaaagcccgggcctttcctgggtcagggcagccggctttccttgtccacgtgtggccggctgttttcttggggagccccggccacagccggcaggactccctttgctccatgtgactctgagggcctcacaggtatttgcagcccaggtgctgtcggagcccagccgatgckaccgacacacagcacaagcgtcatcctgttctgcctgtcccttgcgtgtggaggggactcgtgcccagggctctccttgctggcttgttggaatctggcttcaggtctacacggggcctctcgtttggtccagaacagcctggctcatcggctggggcttgcttgtgcagggctggagcgagcacgtgctagatggagacagcagactcggagtgtgcatttcttcgtgttgcaagcctggcctcacagtgccttcttcctttggttgtctgccaggggtagccctgcaccaggaggaag

SEQ ID NO: 262 - DNA, 601 bp, Human
ttggttgtctgccaggggtagccctgcaccaggaggaagcttagaaatagcacaggtgggaaccggagagagagcactgttggggaagctgcggtcactcatcagccttcctggtgagaaaccaggggtttcctgctaattctggaaaggatgtttcagcagtgcctgcatgagacgcctcagatagaaaactggttatttttgtttcttagcactgccaccatagataacagctgtcacgatggacagtgtggacctggattagtccttcttgggaaaggagagtttgggttttgtaccrtggtggttctgggttctgggggaagagaatggaaccgtacgaggtaaaacaggagactctgaaggccacttggccatccaggcagaaagccagggatggagaggggcagcagggctgtgttcagtgctcccgccgtacgcttgtatgcgggaaaccactgcaggcggcccatgaagcctcctggccatgtgcgccctcccggtttggaccccctcccgtgtgtcttggctgcaggtttgaactgatgcgcatgtgctggcagtataaccccaagatgaggccttccttcctggagatcat

SEQ ID NO: 263 - DNA, 601 bp, Human
tgccaggggtagccctgcaccaggaggaagcttagaaatagcacaggtgggaaccggagagagagcactgttggggaagctgcggtcactcatcagccttcctggtgagaaaccaggggtttcctgctaattctggaaaggatgtttcagcagtgcctgcatgagacgcctcagatagaaaactggttatttttgtttcttagcactgccaccatagataacagctgtcacgatggacagtgtggacctggattagtccttcttgggaaaggagagtttgggttttgtaccgtggtggttytgggttctgggggaagagaatggaaccgtacgaggtaaaacaggagactctgaaggccacttggccatccaggcagaaagccagggatggagaggggcagcagggctgtgttcagtgctcccgccgtacgcttgtatgcgggaaaccactgcaggcggcccatgaagcctcctggccatgtgcgccctcccggtttggaccccctcccgtgtgtcttggctgcaggtttgaactgatgcgcatgtgctggcagtataaccccaagatgaggccttccttcctggagatcatcagcagcat

SEQ ID NO: 264 - DNA, 601 bp, Human
agccctgcaccaggaggaagcttagaaatagcacaggtgggaaccggagagagagcactgttggggaagctgcggtcactcatcagccttcctggtgagaaaccaggggtttcctgctaattctggaaaggatgtttcagcagtgcctgcatgagacgcctcagatagaaaactggttatttttgtttcttagcactgccaccatagataacagctgtcacgatggacagtgtggacctggattagtccttcttgggaaaggagagtttgggttttgtaccgtggtggttctgggttctgrgggaagagaatggaaccgtacgaggtaaaacaggagactctgaaggccacttggccatccaggcagaaagccagggatggagaggggcagcagggctgtgttcagtgctcccgccgtacgcttgtatgcgggaaaccactgcaggcggcccatgaagcctcctggccatgtgcgccctcccggtttggaccccctcccgtgtgtcttggctgcaggtttgaactgatgcgcatgtgctggcagtataaccccaagatgaggccttccttcctggagatcatcagcagcatcaaagaggag

SEQ ID NO: 265 - DNA, 601 bp, Human
ttgtttcttagcactgccaccatagataacagctgtcacgatggacagtgtggacctggattagtccttcttgggaaaggagagtttgggttttgtaccgtggtggttctgggttctgggggaagagaatggaaccgtacgaggtaaaacaggagactctgaaggccacttggccatccaggcagaaagccagggatggagaggggcagcagggctgtgttcagtgctcccgccgtacgcttgtatgcgggaaaccactgcaggcggcccatgaagcctcctggccatgtgcgccctcccrgtttggaccccctcccgtgtgtcttggctgcaggtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccgg

SEQ ID NO: 266 - DNA, 601 bp, Human
ctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatcygactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagtctggcggacaggcttggagtcaaggggccccatgcctgcttctctcccagccccagctcccccgcccgcccccaaggacacagatgggaaggggtttccag

SEQ ID NO: 267 - DNA, 601 bp, Human
taaagttttgtaaacaaaactcaaatttctgggtagaccacaaacactaatttaaattagagacagttcagaggagagatttgttaacaaaatattaagcaaaataatggctttgaggaacttagtttcggcttctggagaccaatgcctacccttgcaaatactaattaaatcacactcaaaacattcctccttattcagcattcttcattagcatggctttgaatacttttgttttacttacatttagaagaagaaacagtgccaagcaccggcttgtaaatgtgaacctcatttttgrtttttgaagatctctttgtcctagaaaaatataaaagcaacaaagactaaaattaatatatctctaatattggctatggcatttcattttcattttttctatttgacttaaagaggatcaacatcccaagacaccctaaaaaacacacgtaagaaaaaacagtatgcttgtgatgcaaatgcagtgaagattccattgcttttcctgtcaactagattgttatacctgaggccctcctattaagaaattctggcactacctttgcatattaggacagaaataaagacattccaagagagc

SEQ ID NO: 268 - DNA, 601 bp, Human
ttattagcaaatgttactctgatgtgacagaaaggataagaagcaaggcagctccacattgatttacgtaaaatttactcatctcccattcatgtgctattgaagctgatgtgatggtaggttaacaatgttgacacaaataataggcattgatagtgttctctaagatgattatatttccgattacttgctaaatcttttaggaataaaacaatatagaattacacaaactgaacataatttaaaagattggagaaagagttatagaataatagtggtatataaagacttgaagtttccrtagtcagtttttgatgaaaaatacatttgaaatcaatagccagactgaaagagttcagaagttttaaaagaattgaacagcccagatgttttaaaaggattgaacagcccagaaactatcattcaaatcatagttttgaactaagattcaaaacatagttttttcaacatgaaaacattttacctgagaatattatttaccaactatgttaatttctaagataatatggagatgtctaaaattaatgctaaagttttgtaaacaaaactcaaatttctgggtagaccacaaacactaatt

SEQ ID NO: 269 - DNA, 601 bp, Human
gcatgattattcaaaaatattcacatataccagatcacttaggatttcatttgagctatgaaaaataacaatatcaataatatatagcaatatttttacatccatagaagaccacataaggcctgggtatttactggcaaattaaaatattctattagtttccatagtagtcttgtttagtgtttttattatatttccagtgacataaagaaacctgcatttccaaatactaattacttttagaaaattttactgtaatttatctaaagaaatatttaataggataaaatgataagacaamctgacaataaaataagttatactcattatccaaataggtgcaaaagggttgcattaatagtcattcccatacaccatttatttgatgtacaatattacaaaataaaaattgccttacaaattaaattaacatttatgaaatactagcaatatttttttcttgaataatataaagacaaacagtttagacagacttgtaggcctataactacacattaataaacaatggaaatcctcgaaccctatgcaagctttgtgtgggtcagtatgacagtatgagatattgagtgatctttgctgc

SEQ ID NO: 270 - DNA, 601 bp, Human
tttgttgtcatcagcatcgtcactggcatctttttctgagagctcactgtataccaactgctgctctaagcttactgtatacctcgcaggagggagaggaattgagtgggtggttatggttaatggaaagaggctaattgaaggtggtgacccaaactgagactttaaaacctatatggaaatcgagttgatagagttcaatagttagtgtattttcacaacaatctattgtctaaaaagtaatatttcggattaattaggaacattgtcattaaaattttttttctctgagaagtgtcartgtgaacataataaacgttttgaagaaaatggacatatcaaattttgttttatggacaaatcctccaaatcaaatatataatccaaatacagagagagaagcaaatttctctctgtcacagcaaagagagcacaaacccatttaagtgccctgttcagttatgcttgctggtcaagaggtgcccacaagccataaaatgtttctgtccatggctcatgcaaagatgtgcatttttttcaatatttaaattatagactacattagtaaaagttttgaataaaaatgacctacgttgctttt

SEQ ID NO: 271 - DNA, 601 bp, Human
gctctgaagaacctaatttttatgtctttgttattaccattggctttgttgtcatcagcatcgtcactggcatctttttctgagagctcactgtataccaactgctgctctaagcttactgtatacctcgcaggagggagaggaattgagtgggtggttatggttaatggaaagaggctaattgaaggtggtgacccaaactgagactttaaaacctatatggaaatcgagttgatagagttcaatagttagtgtattttcacaacaatctattgtctaaaaagtaatatttcggattaaktaggaacattgtcattaaaattttttttctctgagaagtgtcagtgtgaacataataaacgttttgaagaaaatggacatatcaaattttgttttatggacaaatcctccaaatcaaatatataatccaaatacagagagagaagcaaatttctctctgtcacagcaaagagagcacaaacccatttaagtgccctgttcagttatgcttgctggtcaagaggtgcccacaagccataaaatgtttctgtccatggctcatgcaaagatgtgcatttttttcaatatttaaattatagac

SEQ ID NO: 272 - DNA, 601 bp, Human
cagatcagtcagcaaatattgatcaaacttgatgagcccaacattgtgccagatgctgaggatacagtgctgaataaaataagtgtagactgtgctctcatagagcttacagtctggcaagatggaccaacactataaaatatatttctgatacttgaaattatgaacaataaagaatcatcagtcataaaattcttagatattcctaatggaattggaacacgatttgcaaaatttttaaaaaagagtaatttgaagggattccatgttgaggtttctttttttagtttattactcaacwtttgtatgaatatgtgtgttttaaaaattcaattacatattaggcaaccatcaaaacaagaatggatcatgatgccttcacaatagagatattaattattggttcaacttatacatttattttagattcttcttttgtggctctaaaatcttcagttaatatgagaatgatcatttgatgtattattaatttctggaccattttctcaccatcttcaaatcgaattagaagatggaacatgatgtcatatataaatcttatctgtcacttgtattagatatgctaaacactgggaagtat

SEQ ID NO: 273 - DNA, 601 bp, Human
agatacaaggtagaatttgaattgtatcttgagtgtgggaagtttctgcataggcacaagggggggtcgagaagccttttgggatggagggacctttcccacaaaagtctggaggttggaaatgacatgcatgagccactgtgagaaaaccatcttgcctgaaggggagcatatttgagggtaagaaggtcaggactttgctttcaagactgcattatctgaatcttcagataacaaaaaaagagttaaaacttgttttgtcactttgagcaggttagcaacctctcactagatctgtttyctcaacctaggaaacgtaaaataagaagagcggtaagaataatatttatcatctgtcatgttgtgaggatgaacaagacaataaacaccaagtgtcagggacatgaaaggttcaaaacattttagctaatattgttaaaacatggtatataacataatatatatgataaagatgttttgtagatttttgatcagtgaaggttgtgaaaggagaatttttagtaaaattcatgcagcaggcatcagatgtccacaggttaaagttgcggggtggggtgggggcagccaggaagttgaaggc

SEQ ID NO: 274 - DNA, 601 bp, Human
tttaggaatgctgcttaatttctatcatacccgttgaaatttcaattctaagattgaagtttctccaattgtattgatggcagaagtggtgttatgtactcttctatatgtgctagtttctaaacaaaactcatccctattaagttgacatgtatattcctggctcttcatggtgaatcctcactgttttccatgtgtgtcattgtatatgtcctacacgacagcacatcactaactgctaagctgtccagcacagaatccaatcaaaattcagagtttggagagagtagggagcaaaaayattcaggatggctacagatacaaggtagaatttgaattgtatcttgagtgtgggaagtttctgcataggcacaagggggggtcgagaagccttttgggatggagggacctttcccacaaaagtctggaggttggaaatgacatgcatgagccactgtgagaaaaccatcttgcctgaaggggagcatatttgagggtaagaaggtcaggactttgctttcaagactgcattatctgaatcttcagataacaaaaaaagagttaaaacttgttttgtcactttgagcaggttagcaacctc

SEQ ID NO: 275 - DNA, 601 bp, Human
atctgattttcttctcaaaaccatgaaaactctaaaagcttcatagcaagaacataaaatgaaaataaacactctacctgatggatcaaaatccggaaaataatctgggcagaactgataggacaatactccagccggtgtgtcatcccagcacagccatccatcccaggtgcgattgcaatatggacctggccatttagaaggaaattgatattgaagccttgtggatttaactaaatgagaagattgatcccaagacgatattacaagtagctgagctcactacaccagtcataaccamccacatttcaaacaagccaagtcatttattttggaaataaagtttcaaataggcttagcatatctgtgaccaaattatctcattggatgacaagcagggttctatttctactttgtaaaaggttccaaagttgagtgcatcaaaaaagcaaatgccccaaagactgcaagaccctctctcaaaaaaaaaaaaaaaaaaaaaaaaaaaaaaaaaaattctacctaaaaccatgaagatttacttctataaaggtatgtattcaaaagaatcagatccaggctttcaagaaagctctcaaaa

SEQ ID NO: 276 - DNA, 601 bp, Human
cactatttatatccactttggcaagagccccattgttactttggaactggcctagtagcctcaattgcacaacagctcttcgtgccaatcaagtaacttctaatgtagttgtcaaatcaagattaatgaagcatcattcattgggaagagtcaataagggcctgaaggattatcatcaaatagcatttagttagagattccaggaatgtagctgatttagggcacagcacaaagccctttctttcttcacatcccaacttttccatcacaatgggaattcccagaagtggctggcctgcaytggttttaaaagaggtcctctgcaattccacttccattatctctgccttactgaggtgaaattttgttttcagggacagattagatctttcactctggaaggaagcacaaaaagcatttttctaacattgtttcaggggtagactcatttttcttctttaattgggattctagagccacttaacccctgtaggctcaggctcactttactcttgggaacaaatttcacccattaacagggacctatatgttgtgcccatagctaatccatttagtttcagcatctgggtctccttcataa

SEQ ID NO: 277 - DNA, 601 bp, Human
accgtcccaaaccatatttggaccatttaatggctctgtgccattaaaattgtttgtttgtcttcaagtgcagggctgtaaatgcttccttgttaaattttgctttttacattccagcatattccttcagaatgtcagcctcttttgaatttcaatacagttcttcactctttcactatcttttaccaagtactttttccaaagtgaaacaaacctctggcatttcattaatgtgttttgtacatcattaagatgtaagctttaggtcaataagaaaatcctgaagaatttaagtttggtrtgtgtgtgtatgtgtatatatatattatgttatgtatatgtttataatttaagtttggaatatatgtatatatttcagatacacttttaaaatgaatttatcctgcagctgagaggtttctgtataagaaccaggctgaaaagatggatcgatgcctgtaaatctctgatttttttatcaaaaccttgccttgtagtcactatttatatccactttggcaagagccccattgttactttggaactggcctagtagcctcaattgcacaacagctcttcgtgccaatcaagtaacttctaa

SEQ ID NO: 278 - DNA, 601 bp, Human
tgaaattcacactaaaatattaggccaccatagcaactacaataattttttaaaataacatttgataacttaaaatataccagaccctacatcaagtgctccatcttaaaaataaataagaaaacttctttgttctgtattttgcttaattattaactgagtatatatctgagattctgggtaaagtgcatgaggctgggaaatcacatcaatatatattgggagtaaaaagtggtcagaatggtgagataatatttatcaagacactattatcagcaggataaacacactgtaaaactastataattgttagcaaacaactaaaatggcactgaaataaaattagaatttggctggattgtctaaaaaaaacctcgcttttgtattataatactggtcaacaatattttaatttggtactgggactctagaaggtgaaatctcataaatgatcaaggttatctacattccattccagtgacctaaagaattttagataatgttgttagctacaagataatatttaaattctaacctctgaattggccaagcaactgaaagaaaaaatcaggttgaattaaataacatagaaataatgaac

SEQ ID NO: 279 - DNA, 601 bp, Human
ttgaagtgaatattgttcttcccattttatatataagtaaatttcccttccataactagcaggtagaaaggtcaggaatcaaatccgagtctacttgattccaaatctattgcagagctattaagcactaattaagcctcttatttctgtggcaatgtgccaactggtcagaggaaacaaaacaggcaagcccttattgttaagatgcagatgtaggtgagaaaataagatgatgtaaatggtacctggaagttggatttggcatagaaataaaaggtaacactggtttggcccccccccytttttttttttttttttgaaattgatgcttagcaaagaggaggaaagcctgacatcttactatccctccaaccagcaggtcagtgattctggggctgcccactgagcttaagagttcagcttacactaaaatattttggaggaaaaggataagaagattttctttgagccctgagaaagaactttttccaagtgcttgctttgtggtgtctgctggttcccatcaggcttattattttttcaattatttttgtgtgatatattcagtgctggttacagtatgataaagccttgctgcttt

SEQ ID NO: 280 - DNA, 601 bp, Human
tttgaagtgaatattgttcttcccattttatatataagtaaatttcccttccataactagcaggtagaaaggtcaggaatcaaatccgagtctacttgattccaaatctattgcagagctattaagcactaattaagcctcttatttctgtggcaatgtgccaactggtcagaggaaacaaaacaggcaagcccttattgttaagatgcagatgtaggtgagaaaataagatgatgtaaatggtacctggaagttggatttggcatagaaataaaaggtaacactggtttggccccccccyctttttttttttttttttgaaattgatgcttagcaaagaggaggaaagcctgacatcttactatccctccaaccagcaggtcagtgattctggggctgcccactgagcttaagagttcagcttacactaaaatattttggaggaaaaggataagaagattttctttgagccctgagaaagaactttttccaagtgcttgctttgtggtgtctgctggttcccatcaggcttattattttttcaattatttttgtgtgatatattcagtgctggttacagtatgataaagccttgctgctt

SEQ ID NO: 281 - DNA, 601 bp, Human
tatttgttttgtttttaataaaagaaaacttttctacaccctgaaagcatctcaacagcaaacaaagacactaatgtgcttttagttttcaactgaataattatttagtatacaggcctatctttgacagaaataataggtttatgttagagtcagcagggttgcttagagacgccctgcacagctaaacattgaccaactgtaactccttgttctgtagggtgaggaggctggttgtagacttggtgaatttttcagatttttgatacatttgaggaagaaagatcatctgttccccacycgccatttgcttagataaatgtttctaagcagagataatattcaaaatatttaacatacagtaaaatgcaagtactaacaattgagaatgaacttccactgaaaataatctaagcagccatatctgtattagtggactgatgagatgccctactttaggagttctttctatgctttattacaaaactaaggttgtggctaacacaggggaagcatgctatcttgtgacttgtggaaaaatctgtagttttgaaactcttccaggaaaagagatgttagagagtcccttgaaatgttgcct

SEQ ID NO: 282 - DNA, 601 bp, Human
acttgtttttcttggtgaagcataatttgtgtattattttgtagttgtactttaatctcttggcttttggtcttaagttccttcaacagtttgttgggtcttggtatgaatgcaaatgtagtgtagataggatgaataccttctatgaagttctttgaattcctggaataaatgtagaatttatatatccttgaacattttgattcttgtcaatttcctcagaaagagtctgggattgaagccctagtcagctaaaatgcatccaaactattcagagccctttcttggttatgtgcattatgttatcctgaaatgaacattccttttctaggccttagaatttcaaaatggactaattagcttctcctaagttgtgcctgttgcatcatttgaccaggcattccatatttttggggcattttcattgttgataccactctcttaatagcacattttactcttacaggaaatgttaataaagttagaatagttggtttataattggagctgataaaatcttcaggtagctttcttgggagggatttaggaatcttatacacacacacacacacacacacacactcacctatcttttctccca

SEQ ID NO: 283 - DNA, 601 bp, Human
ataatgtaattttatcaacagagaaaatagagattgatccagtcacccatccctctctctgtcttctctgtctctctgtttctctttatctgtttctgtgtttctggtctctctctctctctttctctctctttcactctattttgacactagcttttgcattttgtactatttagccaatttcatcagctgtaattgaagtagacttgaatcttttgcaactagggattttgttttcacttgtttttcttggtgaagcataatttgtgtattattttgtagttgtactttaatctcttgrcttttggtcttaagttccttcaacagtttgttgggtcttggtatgaatgcaaatgtagtgtagataggatgaataccttctatgaagttctttgaattcctggaataaatgtagaatttatatatccttgaacattttgattcttgtcaatttcctcagaaagagtctgggattgaagccctagtcagctaaaatgcatccaaactattcagagccctttcttggttatgtgcattatgttatcctgaaatgaacattccttttctaggccttagaatttcaaaatggactaattagctt

SEQ ID NO: 284 - DNA, 601 bp, Human
ctttcctttccttataatgtaattttatcaacagagaaaatagagattgatccagtcacccatccctctctctgtcttctctgtctctctgtttctctttatctgtttctgtgtttctggtctctctctctctctttctctctctttcactctattttgacactagcttttgcattttgtactatttagccaatttcatcagctgtaattgaagtagacttgaatcttttgcaactagggattttgttttcacttgtttttcttggtgaagcataatttgtgtattattttgtagttgtaytttaatctcttggcttttggtcttaagttccttcaacagtttgttgggtcttggtatgaatgcaaatgtagtgtagataggatgaataccttctatgaagttctttgaattcctggaataaatgtagaatttatatatccttgaacattttgattcttgtcaatttcctcagaaagagtctgggattgaagccctagtcagctaaaatgcatccaaactattcagagccctttcttggttatgtgcattatgttatcctgaaatgaacattccttttctaggccttagaatttcaaaatg

SEQ ID NO: 285 - DNA, 601 bp, Human
taaattgtcattttcaaagaataaagttccttgagatgaagtacctcattcaaaaatatatttcagaagtagctttaaatgcattaaaaattatcatccctaagcccagtaagcaatcctggtagttttttaacttctggaatcttttagacagtggatacataattctataccacagaactggcaaagcagtaatcgactttccaagctgtcctgacctacagagggtccagagagtatggtggcaggtttctgtgcctttgtttaaaatgatatcattagtatttagttggttgaagcygaaacctttccccttggcagccatttgataattctttttttttttcacgatcatggttaattttatttattctcccataatgttatgttgactcggaagaatgtccttctcataaaatgcataatgtcatagcatcttttttcctagtaatcacagtctttcctttccttataatgtaattttatcaacagagaaaatagagattgatccagtcacccatccctctctctgtcttctctgtctctctgtttctctttatctgtttctgtgtttctggtctctctctctctctttctctct

SEQ ID NO: 286 - DNA, 601 bp, Human
tactacaattataacaaatatttcagatagtgaaattaatttttagctttactcatgtcattttatgaaaataaattgtcattttcaaagaataaagttccttgagatgaagtacctcattcaaaaatatatttcagaagtagctttaaatgcattaaaaattatcatccctaagcccagtaagcaatcctggtagttttttaacttctggaatcttttagacagtggatacataattctataccacagaactggcaaagcagtaatcgactttccaagctgtcctgacctacagagggtscagagagtatggtggcaggtttctgtgcctttgtttaaaatgatatcattagtatttagttggttgaagccgaaacctttccccttggcagccatttgataattctttttttttttcacgatcatggttaattttatttattctcccataatgttatgttgactcggaagaatgtccttctcataaaatgcataatgtcatagcatcttttttcctagtaatcacagtctttcctttccttataatgtaattttatcaacagagaaaatagagattgatccagtcacccatccctctctc

SEQ ID NO: 287 - DNA, 601 bp, Human
tttatcagtctttctcctgttaaaccatttatggaaggagctcattgtctgtttgcttatgttatcatttgctatccagttaaaaattgctgttcacctctattgcttagtcaatataagaatcttgactaagatatagacaaagattgaaaaatgatgaaggaaaaaaatagtacttgtactaaggatgtatttacaggtgattattctccccttggtttaattttccttagtactatcctgacaatattttaacaaaaatcaaattaagattctactatgttttaaatttattttttgmggtaaagtatagatgtataatgtaccatctttaccattttaaacatatagttcagtagtgataaatgcatatatattcttctcccccctcattctatatgtgaatcactgtacatttaatcacataccacattttttaagtgtggatgattgttggtcatctgagtctacaaaagggcttttctttatcatttctgtgataccaccatgactattattactaccaataataataataataatgatatcaaacacatatttcacttattatgtgtcagacatgaatccaggcaccttacat

SEQ ID NO: 288 - DNA, 601 bp, Human
aatttttctttcaatttttttatgattatatttaaaaaacttaaaaaatatgctttagtggcatattttaaaataaaagttgtttgagaaccatgatgatgtgtttatttaccataatgaagtgcaattgaaaaatgaagacattccaagattaatcatgttatgtgattactgtattctgatcattatcattgaaaatactcttctattctaatttgagtaattaatacttcatgtctttttgctttatcagtctttctcctgttaaaccatttatggaaggagctcattgtctgtttgyttatgttatcatttgctatccagttaaaaattgctgttcacctctattgcttagtcaatataagaatcttgactaagatatagacaaagattgaaaaatgatgaaggaaaaaaatagtacttgtactaaggatgtatttacaggtgattattctccccttggtttaattttccttagtactatcctgacaatattttaacaaaaatcaaattaagattctactatgttttaaatttattttttgcggtaaagtatagatgtataatgtaccatctttaccattttaaacatatagttcag

SEQ ID NO: 289 - DNA, 601 bp, Human
tcttaaaggtgatggtgatgtagagtatttgaaaaaaaattctggaaaaaatttgctaattcacaaataaattccaatgatagatcagtattattttctacttccacaatcacttttaatgtttctgaaattcaaatataaaaaacattaaagggttaggatcatacttaaattttaagaagacagatgccctttatatttttagtttgggtaaggtttaagatatgattgaaaacaagtataaaaattttatacagctttttttggtttgaatatttggcatctcagcatatgtgctttkcatatctcatttgtctcttgttgtgtctgctctgaagaaccagctatttcagttcatttcttctcattattaggctcagatgataaatcaataagacttgtttttcttccccagatttaagttgctgtttagttggttcttagaactgagagacggtagggcaaagttgggtactttctagacaatctgcccccacactctctcaagggtttgatcagaatcattttgctttgggactaactggagttgagaaatattctactttgcccttgtgccacactttaacacacccatcttcag

SEQ ID NO: 290 - DNA, 601 bp, Human
attggtcttgagttttgccagttgactaaatcagtttgctatcacagggtgagaaacagcagtattttctcctgtatatctcctatgtaagacagtgtaattatagtcacattcaaagcaaacaaagtagcaaaaagaaaacaagtaaaagttgttttgaagttactggtgcatgggaaaatatgaattaggaatcatttctgtaattggtacaagcccaagtcatatcttctagtgtaacttttagttttcatttacctaggatcacgtgttattcatgataaacatgagaactgaaaaraagagagaaaatgaagtaaaatggattgcattaaaactcctgggaaaattcaaatacaatatattatatatcttccctatttgacaagagactttatgccttttgatttagcacaaaatccttatcattaataaattctctttcaatcaaaattcttgcttttcctattactactgttctatgggtgaagaatatgccgtggtatgatcaacagttatctttggtgtctgtcctgccagtggtgagttggaagaaaggaggccatctttgataccattgatttcatggtttccttggagc

SEQ ID NO: 291 - DNA, 601 bp, Human
aaggaatttattttatacatctagaacactctctgacacatcattgggcttaatacccatttttttttaaatttaaaaatgtatttaagaaaaatgttctgttttgagctgtgaccactaagcaattttccagtacaccaaagaattacattaaatgctagatgatttcctactttatacttcatatcatactgaacatttgccaaattcttcagtttcgtattaactagctaacatggaacattatcctgttgttcaacactagttaaaaatgaatatatcatacagcatatatgcatayaaacagtatatatatatttagatagatacagtacatataaagagtactgtatctctctatataaaaatatatatatttttcattggaaacacagagaaaatgatagtttaaaactagataaactgctagcctccaaaggagaagtatgactaatatatgagtttctgttttttgaaagttttaatataatttttgctcattgagttttaaaatttgtattatactaacttgatgacatttacagtcatctttttgaagtgagtcgaaggtattgcaaatttttcaaaattcattcaataa

SEQ ID NO: 292 - DNA, 601 bp, Human
tcatatttgataaggcaaaaaatattagtataatgtcattcaccatgtgagagcgtaaaacatgccaatgactcataacactaactattcctaaaaatatcttcatggaataaagttagaaatgaagaattttgaaaaggaaattctggggaaagatgaaatacaaaaatagcctgggtttacttacaatgccttcctatatttccaattcaaaggaaaaatagttgtcaattttctgcaataaaaagcaatttaagtaataaaggcagctgttagagcatattttaactattatagttayagttttcaacttttcgggaagcgattatagtaactcattaataaataatatttttaaaaatttaacttgttaaacaggtataggatgtagaatttacatccatgaggcaggctctgataaagacaggatttagagaagagctttctcttacacacacgcttctgtggactactctattcagcagtacagaagtctgttaaataaatcaaacccaactggttttataatagcactaaaggtaggttgcaaatttaaatttaaacaaaaaaattacttatgtgaaacctcatgctcgtttat

SEQ ID NO: 293 - DNA, 601 bp, Human
ttatcatatttgataaggcaaaaaatattagtataatgtcattcaccatgtgagagcgtaaaacatgccaatgactcataacactaactattcctaaaaatatcttcatggaataaagttagaaatgaagaattttgaaaaggaaattctggggaaagatgaaatacaaaaatagcctgggtttacttacaatgccttcctatatttccaattcaaaggaaaaatagttgtcaattttctgcaataaaaagcaatttaagtaataaaggcagctgttagagcatattttaactattatagytacagttttcaacttttcgggaagcgattatagtaactcattaataaataatatttttaaaaatttaacttgttaaacaggtataggatgtagaatttacatccatgaggcaggctctgataaagacaggatttagagaagagctttctcttacacacacgcttctgtggactactctattcagcagtacagaagtctgttaaataaatcaaacccaactggttttataatagcactaaaggtaggttgcaaatttaaatttaaacaaaaaaattacttatgtgaaacctcatgctcgtt

SEQ ID NO: 294 - DNA, 601 bp, Human
gagctatccaagtgctgctgcttcttggtagagtcattccccaccttttgtgtattaagcaatttattggggcttttattcttttctctccagttcataaagttgtacatatgtgttggtgtgaatgttcacataaataaacattaatttgaatatcctatttcattttttgatgcaatagagagagcctacatcatggctataacaaaattgcggtgattattctagacaaatgaaaatcttatatttatcatatttgataaggcaaaaaatattagtataatgtcattcaccatgtgaragcgtaaaacatgccaatgactcataacactaactattcctaaaaatatcttcatggaataaagttagaaatgaagaattttgaaaaggaaattctggggaaagatgaaatacaaaaatagcctgggtttacttacaatgccttcctatatttccaattcaaaggaaaaatagttgtcaattttctgcaataaaaagcaatttaagtaataaaggcagctgttagagcatattttaactattatagttacagttttcaacttttcgggaagcgattatagtaactcattaataaataata

SEQ ID NO: 295 - DNA, 601 bp, Human
ttcccatgaaaaattttctgagtatggcagatagatgttttgaacaatcaaaactggtaaaagaaatataccacagattttatttcaaaggaaataaatctggcagaaagtatgtgtgtgtttgtgtgtgtgtttggggtggaatgttattttcaggtctttgactggaaggcatttgatcaacaccaattattatgattgtgatgatcagaattgccattgcagtgattaaattgtatccagtctattcttagcatgaccagatttggaaatctagaaattgttgagagggtgtacatayggatgagaaggccagggaaaggaaagattagtctctgtggaaggctggggctaaaagagaaaaaaaaaaatagtaaaagaccattttgagtaaattttgacctgttttaggacaggaaagagcaggagaacctgttacctgatgtggaaccagcaggatagtgatagcctgatttctaacctcactggatggttaaggaaacagggtgcagcgctgctctccttataagggagcagccatgcagatgaggtgatctggtgaatatcctagacagcctgtacagttcacaaagaccccttt

SEQ ID NO: 296 - DNA, 601 bp, Human
gttctaacataccattttcccacttgggctcagaaagagaaacaaagtctctggatttattttgagatggatattttagaattagagagaaagagaagtatatggaaaactgaatcccacctcatcattttgtagaaaggaaagtgctttctacttcatctggagacgagtatagaccccacaccttttaacgcccagggctctttgccttcttctagctatgatgcctccttttaggtagtttgctttttctgtttttttttcttttttctttctctctccccaaggtcccaagatccayaacaacccattcttcccaccaaagatgatgagattcagaataatcctgtctgtgtaggattcattttttaagagggatttaataaattctatttgttcaatatagaagtccatgggggaaatttccttcctttgatttctaacaaggggaaaaccagcaaggcaaggcaaagaaacagtctggagagggctgcaaaataagtgatcttcctgagaactaaacttcagtatttgaagttacttcaattggagagaaatcgactactaagtggtgccatgcagacttggaagggaataacta

SEQ ID NO: 297 - DNA, 601 bp, Human
tttctgtgagttatatacaaaaaggggtctcaaaatattgaattttcacctaagaacaacctcagcttttaaacccaggaagcatattttcaataggaccacagatttaatgtttggcctgaaataattttgagtttgcttatacaaaacatgattgtgttattcacagcagttctaacataccattttcccacttgggctcagaaagagaaacaaagtctctggatttattttgagatggatattttagaattagagagaaagagaagtatatggaaaactgaatcccacctcatcattytgtagaaaggaaagtgctttctacttcatctggagacgagtatagaccccacaccttttaacgcccagggctctttgccttcttctagctatgatgcctccttttaggtagtttgctttttctgtttttttttcttttttctttctctctccccaaggtcccaagatccataacaacccattcttcccaccaaagatgatgagattcagaataatcctgtctgtgtaggattcattttttaagagggatttaataaattctatttgttcaatatagaagtccatgggggaaatttccttc

SEQ ID NO: 298 - DNA, 601 bp, Human
gctagtaaaaaaaaaaaaactttttaatttataaacagaaaaatggacacagttattgcaatacgtccttccagattataattttttaaatcaatttttattctgtagtataacctaaagttgtaattttcattaaaaaagaaaaaataagtctttttactcagatgtacaacagtagaatattgtttgatttgattgagacatctgtagaaagaggttttgttattgtcatcagattaagaaatgtgtcttaggaaagaattaaatcaatgcatttttattttctgtgagttatatacagaaaggggtctcaaaatattgaattttcacctaagaacaacctcagcttttaaacccaggaagcatattttcaataggaccacagatttaatgtttggcctgaaataattttgagtttgcttatacaaaacatgattgtgttattcacagcagttctaacataccattttcccacttgggctcagaaagagaaacaaagtctctggatttattttgagatggatattttagaattagagagaaagagaagtatatggaaaactgaatcccacctcatcattttgtagaaaggaaagtgctt

SEQ ID NO: 299 - DNA, 601 bp, Human
ggtcataacctttaagtacagctgcatggacaatggtagtgtacttgcaaaaatactggcaaattgagtgcatctgtcaagatgttcccctgatattttcacaaaaatcatctttggtcaagccagtcaaaatgctcccagttagaacatcatgtgcttcctgagagtttggttaagagcatccaaataattaaaagccttttacaaattgctgaatgtagcaggtacactatgactattattaccattgttatgtttataatgatgactattaactgagaccagaaagcctttcattgtrggtgaactggcctctcttatggagaggagctgggtcaccccggagggatgtgacctgggacggtgtatgaaagcaatagtctgattgctcctaaagccttagctgatgttcacattctttcttctaggctcttttgtttttctgtctgtttatatctcatgcagtgattgtttccttttaatatgaatacttcagagaagccagtacattccctaccttctgtaggttctggctagagaaactttatgaaggcagcttactgtacctccttgactaaactcaaagtgctagtaaaaaaaa

SEQ ID NO: 300 - DNA, 601 bp, Human
gaccctagatgttcataacacaaacaaacttcttgcagccccttggcctctcacctttacctaggagaatctagttataaaaatcttaaaatatgagctacattgctattatagtgtgagtctgtaatgaaaatgagctcatgataacccctccatgtgtgagtaaaaggcgtttttttgaagagtctaaaatcaaattgcttttttttactacagaataccatcaaattagcttcattttgaagttataaaacatatgatacatagaactatatacacagaaatctcaactaagagataatactactaatattgcaataaaaaactaattctcaccacaagtgccgccatgacaggtccatggattatgtaaagcaaatgggtttccacactcagccagcagctgaaaaagggcaaggggacaattaatacacaaatacattttgtttatgaatatgttaacttaaacatcaccataatacttacttgtcattgaagtacacggccctggtaatagcatggatagtggttggcaccagcgggaaccctacaaatgtgaaaagtacaaatcacacttggtttcttggtcataacctttaag

SEQ ID NO: 301 - DNA, 601 bp, Human
aacagataaagatatggagcagtactaagttttaatgacctagagttagagattatcttccaaaagtacctgaaagattatttaatctaacttttcccttaaaaaaatcaggggacatttttaggttaattgatttatctaaattttcagagctggtagatgatagagctaagacatgaggccaagtctactgaatcctaggtaagtaagaactgtagcatcctcagtaagcatctgacatttggctgggagtccactatttattactaactcactaattgagcttgtgttgaatatttgratttctggaccttaagttcacagaaccaaagacttttagagctctggaatgtcaaagttttcaaagaccctagatgttcataacacaaacaaacttcttgcagccccttggcctctcacctttacctaggagaatctagttataaaaatcttaaaatatgagctacattgctattatagtgtgagtctgtaatgaaaatgagctcatgataacccctccatgtgtgagtaaaaggcgtttttttgaagagtctaaaatcaaattgcttttttttactacagaataccatcaaattagctt

SEQ ID NO: 302 - DNA, 601 bp, Human
taacagataaagatatggagcagtactaagttttaatgacctagagttagagattatcttccaaaagtacctgaaagattatttaatctaacttttcccttaaaaaaatcaggggacatttttaggttaattgatttatctaaattttcagagctggtagatgatagagctaagacatgaggccaagtctactgaatcctaggtaagtaagaactgtagcatcctcagtaagcatctgacatttggctgggagtccactatttattactaactcactaattgagcttgtgttgaatatttsgatttctggaccttaagttcacagaaccaaagacttttagagctctggaatgtcaaagttttcaaagaccctagatgttcataacacaaacaaacttcttgcagccccttggcctctcacctttacctaggagaatctagttataaaaatcttaaaatatgagctacattgctattatagtgtgagtctgtaatgaaaatgagctcatgataacccctccatgtgtgagtaaaaggcgtttttttgaagagtctaaaatcaaattgcttttttttactacagaataccatcaaattagct

SEQ ID NO: 303 - DNA, 601 bp, Human
atttttaacagataaagatatggagcagtactaagttttaatgacctagagttagagattatcttccaaaagtacctgaaagattatttaatctaacttttcccttaaaaaaatcaggggacatttttaggttaattgatttatctaaattttcagagctggtagatgatagagctaagacatgaggccaagtctactgaatcctaggtaagtaagaactgtagcatcctcagtaagcatctgacatttggctgggagtccactatttattactaactcactaattgagcttgtgttgaayatttggatttctggaccttaagttcacagaaccaaagacttttagagctctggaatgtcaaagttttcaaagaccctagatgttcataacacaaacaaacttcttgcagccccttggcctctcacctttacctaggagaatctagttataaaaatcttaaaatatgagctacattgctattatagtgtgagtctgtaatgaaaatgagctcatgataacccctccatgtgtgagtaaaaggcgtttttttgaagagtctaaaatcaaattgcttttttttactacagaataccatcaaat

SEQ ID NO: 304 - DNA, 601 bp, Human
gtctttttggggggcctctattgttttgtcttttacatttaaacctccagttcactaaaaacacattttttggtgtctggttgtggaaggaatcagaatttactttttccccacacatatgcagttgctaaatacgtgtttgatattttttctgtatgtatatcttattgaccatctccttcctctgcccaaaagtgctgctgtcataaatcaagtgcccatatttgcacgggcagctctttcaaaatgagaaaaatcaactattaaggtataaatgattcaccttgttaattgttgaatcttttttttttagttttgaaatgcactaatgtgcatttcctttagtcatgaaattaataagaattccaaatatatcaatttctgttaatttatggtcattcacagtgaagtatgcatatactcaactcagatacacatttataatttggatcctagaatctgcatttccttaaaaatttctagataattaaggcaagaaatatgtattttagaattttaaatataggaataattgctaaagtttttacttcattttactttatttattattttattaggagatattttataatcgtgaatt

SEQ ID NO: 305 - DNA, 601 bp, Human
acattgcagataccttcttggactctaagttttgtcttttcagtctttaaatgttgtcttcattttaatgtagctgatttatcaatctcttccttaagtgccttttgtatcctgctttagaaatctttctgtatctgaagctcatgaagatactcaacataatgtgtctttttggggggcctctattgttttgtcttttacatttaaacctccagttcactaaaaacacattttttggtgtctggttgtggaaggaatcagaatttactttttccccacacatatgcagttgctaaatacrtgtttgatattttttctgtatgtatatcttattgaccatctccttcctctgcccaaaagtgctgctgtcataaatcaagtgcccatatttgcacgggcagctctttcaaaatgagaaaaatcaactattaaggtataaatgattcaccttgttaattgttgaatcttttttttttagttttgaaatgcactaatgtgcatttcctttagtcatgaaattaataagaattccaaatatatcaatttctgttaatttatggtcattcacagtgaagtatgcatatactcaactcagatacac

SEQ ID NO: 306 - DNA, 601 bp, Human
gacaatgttgagcaaaaagaagaaattgacctgcaaatatacggtgttatgagcaaatcatacagaaaagtatcacttaagaatatgcactgttctcaattcttgtttatccagtgtgagcaacaaatgttacctacatagaacatgagagtctacctgagaggtagcacaattggctcagcatttctagggctctagagaagtggtttaattttatgttccctccagcagtatataaaacagttccagttgctcatcacccttgccaacacttggtatgaacactctttttaatatgagmctttctatggcgggggtggtggaggggtgtagtattacctcattcttgttttaatctgcattttcctgatgatacatgagctgaacactttttcataaatttattagtctttatttggaacattgcagataccttcttggactctaagttttgtcttttcagtctttaaatgttgtcttcattttaatgtagctgatttatcaatctcttccttaagtgccttttgtatcctgctttagaaatctttctgtatctgaagctcatgaagatactcaacataatgtgtctttttggggggcc

SEQ ID NO: 307 - DNA, 601 bp, Human
ggcttgtcaggcgtgcgcagtggctcacacctgtaatcccaggccgaggcgggcagaatacctgaggtcaggagtttgataccagcctggccaacatggtgaaaccccgtctactaaaaatacaaaaattagccaggcgtggtagcgcacacctgtaatcccagctactcaggaggctgaggtgggagaattgcttgagcccgggagatggaggttgcagtgagttgagatcatgccactgcactccagcctggtggacagagcgagactctgtctcaaaaaaaaaaaaataaaataaaataataaataaataaataaataaacaaataagtaaaataataataaaagatcatgggctttagagttaaaatcagctagctgaataagcacagtagttgaataaatacacctttggcttccttacctggaaatgaatcagagagtgcatcacgtaatcatatatcttcccaagcatcttgttggaaggtctccagggaaagacgacaaactggattcccagcaggggcacaaggatcatggtggccttcacagccttcaggtacatgtgggattccgcctcatgggtttccctcattttggt

SEQ ID NO: 308 - DNA, 601 bp, Human
tgggcttgtcaggcgtgcgcagtggctcacacctgtaatcccaggccgaggcgggcagaatacctgaggtcaggagtttgataccagcctggccaacatggtgaaaccccgtctactaaaaatacaaaaattagccaggcgtggtagcgcacacctgtaatcccagctactcaggaggctgaggtgggagaattgcttgagcccgggagatggaggttgcagtgagttgagatcatgccactgcactccagcctggtggacagagcgagactctgtctcaaaaaaaaaaaaataaaataawataataaataaataaataaataaacaaataagtaaaataataataaaagatcatgggctttagagttaaaatcagctagctgaataagcacagtagttgaataaatacacctttggcttccttacctggaaatgaatcagagagtgcatcacgtaatcatatatcttcccaagcatcttgttggaaggtctccagggaaagacgacaaactggattcccagcaggggcacaaggatcatggtggccttcacagccttcaggtacatgtgggattccgcctcatgggtttccctcattttg

SEQ ID NO: 309 - DNA, 601 bp, Human
acattgaagatcatgggcttgtcaggcgtgcgcagtggctcacacctgtaatcccaggccgaggcgggcagaatacctgaggtcaggagtttgataccagcctggccaacatggtgaaaccccgtctactaaaaatacaaaaattagccaggcgtggtagcgcacacctgtaatcccagctactcaggaggctgaggtgggagaattgcttgagcccgggagatggaggttgcagtgagttgagatcatgccactgcactccagcctggtggacagagcgagactctgtctcaaaaaaaawaaaataaaataaaataataaataaataaataaataaacaaataagtaaaataataataaaagatcatgggctttagagttaaaatcagctagctgaataagcacagtagttgaataaatacacctttggcttccttacctggaaatgaatcagagagtgcatcacgtaatcatatatcttcccaagcatcttgttggaaggtctccagggaaagacgacaaactggattcccagcaggggcacaaggatcatggtggccttcacagccttcaggtacatgtgggattccgcctcatgggt

SEQ ID NO: 310 - DNA, 601 bp, Human
taaatgttatgacattgaagatcatgggcttgtcaggcgtgcgcagtggctcacacctgtaatcccaggccgaggcgggcagaatacctgaggtcaggagtttgataccagcctggccaacatggtgaaaccccgtctactaaaaatacaaaaattagccaggcgtggtagcgcacacctgtaatcccagctactcaggaggctgaggtgggagaattgcttgagcccgggagatggaggttgcagtgagttgagatcatgccactgcactccagcctggtggacagagcgagactctgtstcaaaaaaaaaaaaataaaataaaataataaataaataaataaataaacaaataagtaaaataataataaaagatcatgggctttagagttaaaatcagctagctgaataagcacagtagttgaataaatacacctttggcttccttacctggaaatgaatcagagagtgcatcacgtaatcatatatcttcccaagcatcttgttggaaggtctccagggaaagacgacaaactggattcccagcaggggcacaaggatcatggtggccttcacagccttcaggtacatgtgggattcc

SEQ ID NO: 311 - DNA, 601 bp, Human
ggagagtgatagagcaggaggcatggacagccttgtgcaaattcctcattaccccagagccagcacttatttataaaggaagatctgacaatttctgtatctatgaccaaggagaacatgcctggatgggaccagctgagggccctgggaatgacaggaaagcaggcacagaaagaaacagcaacaaagagcctcaaaaaaactggtgtccttcagaattttggctgggcttattgaattggaggcttaaatgttatgacattgaagatcatgggcttgtcaggcgtgcgcagtggctcayacctgtaatcccaggccgaggcgggcagaatacctgaggtcaggagtttgataccagcctggccaacatggtgaaaccccgtctactaaaaatacaaaaattagccaggcgtggtagcgcacacctgtaatcccagctactcaggaggctgaggtgggagaattgcttgagcccgggagatggaggttgcagtgagttgagatcatgccactgcactccagcctggtggacagagcgagactctgtctcaaaaaaaaaaaaataaaataaaataataaataaataaataaataaacaaat

SEQ ID NO: 312 - DNA, 601 bp, Human
ttatatgaaatgcatgcttacctcattgttgcagaagcagtagatggtcgcaacaaagaagccctaaaaagggaaggaaaaatacagttgaagttatttttgtgtgcattatgttgtttagtaaacaatataatagactgcccagagaaggcctgatgaaaaaaaaaaaaagcaagaaaaagaattatctaccattcatagtcagtgctgcactataagaatattcccttagaaatatatttttcttgttaggattccatcgtttggctagaaggacggattaatattttgctaatctaawtaatattttgctccctttaacatggagatttatagcagcatatgctgattatggtgaatttgaaaaaaaaaaactacacttagaaaatttaaaaatggagaccttgcagaattcagtagagggatcttttacaagacaagtgtcatagtgggaggctgtgggtctgtgtcctatgttgtcatggtgaactagtgcaatactgtacccaccgccaagttcatcgctcagataaggacatggactaagaaactgcctgagtcctggtcactgcttgaagatttcttgtgcccaagttttgat

SEQ ID NO: 313 - DNA, 601 bp, Human
tttacacaaacaagtgatagtattatatgaaatgcatgcttacctcattgttgcagaagcagtagatggtcgcaacaaagaagccctaaaaagggaaggaaaaatacagttgaagttatttttgtgtgcattatgttgtttagtaaacaatataatagactgcccagagaaggcctgatgaaaaaaaaaaaaagcaagaaaaagaattatctaccattcatagtcagtgctgcactataagaatattcccttagaaatatatttttcttgttaggattccatcgtttggctagaaggacgrattaatattttgctaatctaaataatattttgctccctttaacatggagatttatagcagcatatgctgattatggtgaatttgaaaaaaaaaaactacacttagaaaatttaaaaatggagaccttgcagaattcagtagagggatcttttacaagacaagtgtcatagtgggaggctgtgggtctgtgtcctatgttgtcatggtgaactagtgcaatactgtacccaccgccaagttcatcgctcagataaggacatggactaagaaactgcctgagtcctggtcactgcttgaaga

SEQ ID NO: 314 - DNA, 601 bp, Human
gatattattttagacaaaaaatttattttgcatgccacctgaaacaacccaaaaggcatggatatacattcacagaaattgatataaacacggggtgacttacgccctactcatttattagtttttatcattctaaaaaatattaaaattctaaaaatattgccactctaacagcgggcaatggaaggatgtcttttcatttctattctaggcccttagtctagcccttagcaatagtaaatgcacaatgtatttttgttgaatgaaggaatgagttggtaggtgaatggatgaagaaagraaggaataaaatgtaataactaaaatggagaataggaacaacaaaaactttgtcatgttgcggttggaaacgggtatgaacaggtcacagaatagcaaaatattgtaggtgctcactaaatattatttaacttagtaaaaagatagagaataaattagcaactgacaatggctagaaatgtttctaattactaataggaaagtaatatattgatgtcttggcaaaatgtgatttgccttgtatggaattattcttaataggaattgatttaaaatgttcaaaaatgctttggcattaaaa

SEQ ID NO: 315 - DNA, 601 bp, Human
tcacaagttgcagtgggagactccattcctagactgtctcccaaagcaacagtaccaagaataactttcttcagatttacaatggacaaattcactgaataattcttcacaaatgatatgttcggttcctgggaggatggagaatactttaaatgcatggtctttctcccaggaaatgatggctcagtgatcacgatgctgtgtttgcttcacattcaagcagatgactcttgctctatgatattcaaagggatgatctcagcactctcctcgccttggttgttggctggttcattcctcrgctcctgatggcagatgtaaattgggatgtcgccagcctccgcagcagcggctgcagcgcgagcagagcggttggaggggcgcctcccccaacgctggttccactgaattttgaattgggcccattggcgcttcacggtggtttggacctggaagagaaaaaggagccttgtttttatatgatagtcagaaatgatccatgcaaagtgtacgaacatcgttcttagagcttatcagatttaaagaaagttaaattgtaattctgatctaaagggctgggctgtgtatgctgtggccacag

SEQ ID NO: 316 - DNA, 601 bp, Human; identical to SEQ ID NO: 97

SEQ ID NO: 317 - DNA, 601 bp, Human; identical to SEQ ID NO: 98

SEQ ID NO: 318 - DNA, 601 bp, Human; identical to SEQ ID NO: 99

SEQ ID NO: 319 - DNA, 601 bp, Human
ttctaaactttcagcggactcgattgggcgaaagccttccggctccctttactaagtcgtttaggtggtggctggggggacaaaggagggtttttatctttaaaagataagtacggtttagaagacacgggagaaataatccattttgttatgttatgcagttgaactgtatagcttctctagttttgtgtttttaatgttctgaaattcaaaacagcagggatggccttcgccgacgcaggagtcgggcattttaaaataggctgtttttcttttggagcgttcttcttgaaggatattstttgtgcaagacggcgatttttgagaacacaggcaggagggagggggtgttttaatgtatgtttttactccatgataccaaagcttccccccaggatccctttacagtggttagttcctggaaacctgatgggtggtcagaaggcaccccaaatctcgattatggtttgctgaagtcttgactgactcagtacctgcccctccctccatctctgaaatgtggagaattaaaagctatgcctgtgaacgggcgttcagtttttagccgggaaggtgctagaccacttaactctgatagaaa

SEQ ID NO: 320 - DNA, 601 bp, Human
tttttcttttggagcgttcttcttgaaggatattgtttgtgcaagacggcgatttttgagaacacaggcaggagggagggggtgttttaatgtatgtttttactccatgataccaaagcttccccccaggatccctttacagtggttagttcctggaaacctgatgggtggtcagaaggcaccccaaatctcgattatggtttgctgaagtcttgactgactcagtacctgcccctccctccatctctgaaatgtggagaattaaaagctatgcctgtgaacgggcgttcagtttttagcsgggaaggtgctagaccacttaactctgatagaaataagctgctgagccctatcagggagggcgttctttcagctgttgtctggtggagaaataaagacagggtgttggttcagttgcaggtattttgctggcgtattgagagattagagtttcctctttgagtgtgatggcagtagaaagagtgttgtttatcttagaaaacttagtttctgaagcagaggcagtcatatggatgtgtttgttttgtatcaccataatgtgaacagagcatctaaatgaaggcggttcggaggttctgag

SEQ ID NO: 321 - DNA, 601 bp, Human
acatagcaagcaaatggtgttttgtggaagggtggggtttgtgtcaggatttgaaatgtaaaaggtcataatgtttgatttgtcgaaaaagattagaaaagttcaactctaagaaatatgctaaggttgaatagatgaagcttaaaaatatcacaaaaagtgaaagaagtcagtcacaaaagaccacatatcgtatgatccggtttatgtgaaatgtctagaataaacaaatccatagaggcagaaggtagatgagtggttgccaggggctgggggcggatggaatggggagtgactgctrgtgggcacagggtttctttttggggtgatgaaaattgttctaaaattagtttgtggcgatggctgcatagctctaaatatacttaaaaccattggattatatactttaaatcggggactttaatggtatgtgaattatatctcaataaaccctttttttttttttttaaagaaatgtgatcaggttgaaaataacttgttatgctaccttaaattacgttaaaattattacatatatttgacaggctgatgtctctctctcttttcatttatgagtttttcagatccgtgagttgcagca

SEQ ID NO: 322 - DNA, 601 bp, Human
caaaaagtgaaagaagtcagtcacaaaagaccacatatcgtatgatccggtttatgtgaaatgtctagaataaacaaatccatagaggcagaaggtagatgagtggttgccaggggctgggggcggatggaatggggagtgactgctagtgggcacagggtttctttttggggtgatgaaaattgttctaaaattagtttgtggcgatggctgcatagctctaaatatacttaaaaccattggattatatactttaaatcggggactttaatggtatgtgaattatatctcaataaaccctttttttttttttttaaagaaatgtgatcaggttgaaaataacttgttatgctaccttaaattacgttaaaattattacatatatttgacaggctgatgtctctctctcttttcatttatgagtttttcagatccgtgagttgcagcaatacaacaaactgataattgaagcttagcaacagggattcaatcccgcagtagaaatgggcaagcaggagaaaaagaatcttggttctatgtagcttcagttagggattgaggagctggatttaaaaaacacaaatgctggtggagggcagat

SEQ ID NO: 323 - DNA, 601 bp, Human
ctggaaaatggtgtttggcatcagcttagcaagaggaggttttccagttatttgtaaagatgtgatgtggctttaagtggggatgggggagggtagcagccccagtgtttgtggacattgagacctgttgacatttgggaagcataactgagttccactatttgaaaagattaaaactttgatatatgtacacatcccctcatgcctgcacccccatccccgagggtctggaaaagaattgatttgttctgaggaaggaacatatatttggaatataaaatggttagtaaacaaaggatctttaaaacaagttagattgttatctcaagagaagcatacttcctcggcatgatgttttcttttgttaaattgctttggttttatttgactcaaagtattaacaatacctttgattttgagacttttggacttttgaagactaagtttttaaatggtcaattttactcgtttgaaagtcccagataccatttttgaagatttctctccctttttttccactgatgccggctttacttatgttttattttcaaatcttaaggaaaaactgatatttccttacttgaactgagaaatagtcgtt

SEQ ID NO: 324 - DNA, 601 bp, Human
gaaaatggtgtttggcatcagcttagcaagaggaggttttccagttatttgtaaagatgtgatgtggctttaagtggggatgggggagggtagcagccccagtgtttgtggacattgagacctgttgacatttgggaagcataactgagttccactatttgaaaagattaaaactttgatatatgtacacatcccctcatgcctgcacccccatccccgagggtctggaaaagaattgatttgttctgaggaaggaacatatatttggaatataaaatggttagtaaacaaaggatctttwaaacaagttagattgttatctcaagagaagcatacttcctcggcatgatgttttcttttgttaaattgctttggttttatttgactcaaagtattaacaatacctttgattttgagacttttggacttttgaagactaagtttttaaatggtcaattttactcgtttgaaagtcccagataccatttttgaagatttctctccctttttttccactgatgccggctttacttatgttttattttcaaatcttaaggaaaaactgatatttccttacttgaactgagaaatagtcgttttc

SEQ ID NO: 325 - DNA, 601 bp, Human
tgacagagcgagactccatcacacacacaaaatacatatataaaaataaattgctcacctggtaatagtctggaaaacattttttttttgtttttttgcatattttaaagactttagaaagtagtcttgctaatccagaaagttcttgcggggaggagtttgaaactttgttttatctcactcctcagtcttagcccccttaataccataggtctctacttcagtaagagttacataatacgaatgccgtttgttcagaattgtgtatctccatccatccgtccatcgtccaaattctgcragtttgaaatacattgttgttgctgttttgtatacttttgttcaaccattttctttttaacatggcactagctttctcaaactggctttggaattatttgtcagtttaaaaataaataccactttaaaaattactcttgacatgggagaacaaatatattttgatagttgttagagcataaatattttatagagcataacttgaaatttttcctgatacattgtgattgctttcagcttgtcctctgctgtaaaaaatatagtcgtggttagtctctgtaaagttggttattgggaatat

SEQ ID NO: 326 - DNA, 601 bp, Human
aataaataccactttaaaaattactcttgacatgggagaacaaatatattttgatagttgttagagcataaatattttatagagcataacttgaaatttttcctgatacattgtgattgctttcagcttgtcctctgctgtaaaaaatatagtcgtggttagtctctgtaaagttggttattgggaatatgtgcttgattacgtaaatgagacatcaccaatttaagtcagccaaagtttagtcaatagaactttaaagaacagaagtctaatggtaattagggagagatgaatttatttrtaggagttttccccaaattcaaagcgtcttagtgacctttgataacttcctggaaaaagtaggaagcatggagagaaattccaggtaggagcccatgatccaattgactgcatcagcttacaaagtgttttctaagtcattagctattaattctgtctagattgtaaaatccctctcagttgtgtccacatttatctgtgttgtcctgtatttattctctttacctaatttccctgagtctcattttagtgggataatacacaagcttacagactcaggactttaaagagaagcacagat

SEQ ID NO: 327 - DNA, 601 bp, Human
agaataagaataaatacatccagtgttgtgttaggtcccacaccgtctatatttcgctagctaattttatgtattttgtttcatgttttattgatattttcagaatctttcttgctgagattacacaaaatatatagctggttattcagttttacgtgtcaaaagccttaaacctgtttccccatgattgccttttattatttttaattcggaaatctttgtttggctgtctgagagagaacttcagcctcccttcctcccagacattttgaacagttcaggctgtactcattcgtgtctytttgtcttggcaggtggaagcccctctgcttggaatagcaaacaatactaccagcttgccctctggcaagctcctttaagagttagctgtaatttcaccctctctctggccttgattctgcatgcagaatgattgcactgacttgagctcctgtggtctcttgctatacctcctatttgggcatctcccccatattgctttcccccaccattggggaggggaatggtaccttggttatctttgaattcccaggaggtggcccagtgcctggtgcataggaggagctgaagaaacggaaga

SEQ ID NO: 328 - DNA, 601 bp, Human
tttcgctagctaattttatgtattttgtttcatgttttattgatattttcagaatctttcttgctgagattacacaaaatatatagctggttattcagttttacgtgtcaaaagccttaaacctgtttccccatgattgccttttattatttttaattcggaaatctttgtttggctgtctgagagagaacttcagcctcccttcctcccagacattttgaacagttcaggctgtactcattcgtgtctctttgtcttggcaggtggaagcccctctgcttggaatagcaaacaatactaycagcttgccctctggcaagctcctttaagagttagctgtaatttcaccctctctctggccttgattctgcatgcagaatgattgcactgacttgagctcctgtggtctcttgctatacctcctatttgggcatctcccccatattgctttcccccaccattggggaggggaatggtaccttggttatctttgaattcccaggaggtggcccagtgcctggtgcataggaggagctgaagaaacggaagacttcttaaagggatactcgccattcactttgaagcacttctttgtacaaca

SEQ ID NO: 329 - DNA, 601 bp, Human
actgatggagtggagagggtgtcagaatccggtgtttgtgtggtgggaaggaattgactgctggctagagaatgaggagcgctgaaacctttgcaccattgcagtggacccgctgagaagggtgttctggggaggctgctctggtctctcgatggagtcaggattgggggacagatagacaccccggtgtgagccagtgatggtatagatgagggaggcagtgaggacaggctcagggagggaagtcttgtctctagacctgagaccaggaagcaggaatggactggacaggttggcccasctgagggaggtgactggtgagatgggtcctcggtgtgaggggctgggttgccagaggagctgtgggctggggtggtttgtcgagagagcagtcccagttgatggagaggcaggacccgcaaaacaggttggctgcaggactgggggcggtagcacagggcagctcccgaggagacacctggcacttttaaggcatggaatggagagagctaggggagagcacacctgcagtgaggcaattcacatagcaaagttctccggaaactgcagtgttcaacttttttaaagaatagctggatgt

SEQ ID NO: 330 - DNA, 601 bp, Human
taccatgcaagtgaagaggaacagtttgtttaaagaggggtgccagcttcacatccaggcctggactttgctactggtgcttttgaacttgtgttgatttatgtttgtaaattgactggacacattgtggttcttgatgagaagcaattgcccatccttagcccacgattagtgccactctctgggtgctgcctgttctgccactgtaactgttttcacttgacaaataacattaaaaaacacagttctgcaagagacttcctgggagggtggtatcatttggcctgtgggcttttgtaayactttcctgctattaggagagtgaattctgaattttcaatcacgttcacctgttggagcaagtagagtttcagacggtctccgcttttctcgactagaaagcaggccttctcccttttccccccagtcttgtttcatgacaccattcccctctgagatgagggttggagaattagaagtctactgatgcattgtaccggggcacgttattgaccctctctgctctcctttcctcatctgtaaaatggaagataatgccacccatcaggccgagtgcggtggctcatgcctgtaatcccag

SEQ ID NO: 331 - DNA, 601 bp, Human
ttcacatccaggcctggactttgctactggtgcttttgaacttgtgttgatttatgtttgtaaattgactggacacattgtggttcttgatgagaagcaattgcccatccttagcccacgattagtgccactctctgggtgctgcctgttctgccactgtaactgttttcacttgacaaataacattaaaaaacacagttctgcaagagacttcctgggagggtggtatcatttggcctgtgggcttttgtaacactttcctgctattaggagagtgaattctgaattttcaatcacgttsacctgttggagcaagtagagtttcagacggtctccgcttttctcgactagaaagcaggccttctcccttttccccccagtcttgtttcatgacaccattcccctctgagatgagggttggagaattagaagtctactgatgcattgtaccggggcacgttattgaccctctctgctctcctttcctcatctgtaaaatggaagataatgccacccatcaggccgagtgcggtggctcatgcctgtaatcccagcactttgggaggccgaggtgagcggatcacctgaaatcaggagttcg

SEQ ID NO: 332 - DNA, 601 bp, Human
aattctttgttgtgtatattttaccacaattttaaaaagcttatttctcaattgtttatgcgagtatatgtgtggaatagttggggagacaaattcaaggagaccagtccttgtccatggcggtcctaggtaccacgggatcactgcgggggaactgtgaggtcaggagaggccttgaaaaaaaacgcaggtttgagctgagtcagatggaatgggtctgttttctatatcaagagacagtattgcagataatttttttctttcaaggaaagcaagtcaggagtcaaactctcatgccacygtagtcacaaatgaaatttattgctaatcagccatgtgacgtgtaattgctttttcattttcttatttttccagaagagagatttgtttagatgtttgattccctcactgattatgattatactggaagtttttcatttgttttgacagctcaattttttttttattgtaaatggactccctcattacagaggggggagcccttgaaagaaagggattgacctctgcaggcaagaatctgagcatcctaaaagtagaaaagggctagaggcttcgccttacaggccaggaagcttggagg

SEQ ID NO: 333 - DNA, 601 bp, Human
gtgcctggcccattttataattttgatcattaaaaaatgatgtgataaaattattgtgtattgttgttgatacactactctgattaattctttgggctagattcctaaaagtggaaagtaaggaataagaattgtgtaagtgtgcatgatcctagataaatattgccaaaatattttgcagaaaattcttagtttcagcttccagaagcagtgtctgtcatccatactccaccagaattgaacactaaattgagctttgcaattttagcatttaaaaagttgtatcatttaatatagaatrgcagtctcttcattatgatcttcccttgcctagtaagtttatactcaagtcaaaatcggttaatcatgcatattgattccttgtttatctttttcttttaattctttaatacttctagaatgtatttgtagttaagtgaagtaagatacctcctcctgttgacgatttagtttccccacattgtgctgttttttttcttcactggattatgtaacaatatcttttcttttttttctttctttctttttttttttttttttttgagagagtctcgctctgttgctcaggctggagtgcaga

SEQ ID NO: 334 - DNA, 601 bp, Human
ggttatttctggttaatgaatgctttttgttgctaatgtagaaggaatctttattccccattgtttattttatatttttaaattttttttcaattaaaaaaaatttttttttcattcctgagacagggtctcgctccgttacccaggctggagtgcagtggtgcggtcatgactcactgcagccttcagctcctaggctcaagtaatcctccacctcagcctcctgagtagctgggactactggtatgcgccaccatgcctggctaagttttttctttttcttttagaggcaggatcttgytgtgttgcccaggctggtctcaaactcatgacctcaagtgatcctcccaccttcacctcccaaagtgctggcattgcaggcgtgagccaccatgcctgaccttccttgtttcttttaggtgattattggttgtgtgtgaggaaagctctggtattttctgtacttatcttgtacctacccaatttgttgattgctcttattcgttataatagtctttcagttgactcttcctaatttttttgtgccgagaatcattgatgacaaataaggataatttggtctccatttttctggtacata

SEQ ID NO: 335 - DNA, 601 bp, Human
attttttttcaattaaaaaaaatttttttttcattcctgagacagggtctcgctccgttacccaggctggagtgcagtggtgcggtcatgactcactgcagccttcagctcctaggctcaagtaatcctccacctcagcctcctgagtagctgggactactggtatgcgccaccatgcctggctaagttttttctttttcttttagaggcaggatcttgctgtgttgcccaggctggtctcaaactcatgacctcaagtgatcctcccaccttcacctcccaaagtgctggcattgcaggygtgagccaccatgcctgaccttccttgtttcttttaggtgattattggttgtgtgtgaggaaagctctggtattttctgtacttatcttgtacctacccaatttgttgattgctcttattcgttataatagtctttcagttgactcttcctaatttttttgtgccgagaatcattgatgacaaataaggataatttggtctccatttttctggtacataatacgtctttacttaccatcagttgtgtgtcacttaggaatataaatggctgaaaataactgaaagcctgcctaataaggg

SEQ ID NO: 336 - DNA, 601 bp, Human
agccttggagccgcagcctccttgggtggtgtggcagctgtcagtgtctgaaaccattttgaactttaaagggtggtgtcagacagcagctattgaggctacttaaaagaatttttttaaatgtacgagttcagtggcattaagtacattcatattgttgtgcaaccatcaccactgtccatctccagaacttgttcatcttcccaaactgaaactccatgtccatcaaacaactccccattgcctttttccccaagtctttggcaaccgccattccactttctgtctgtaaatttgactrtctggatacctcatgtaagtggactcgtacactatttgtccttttgtgactggcccattttatgagcataatgtcctcaaggttcattcaggctgtagcatgtgtccagaatctccttcctttttaaggcccaataatatttaataatatatgtatgtgtgataacacatttatataatgtccattaccatgtggtatatatgcttatccatttgtctgtcgatggacacttgagttgctcccccgctttggctactgtgaataatatgactgtgatcatggatatgcaaatatttcctt

SEQ ID NO: 337 - DNA, 601 bp, Human
tttttccccaagtctttggcaaccgccattccactttctgtctgtaaatttgactgtctggatacctcatgtaagtggactcgtacactatttgtccttttgtgactggcccattttatgagcataatgtcctcaaggttcattcaggctgtagcatgtgtccagaatctccttcctttttaaggcccaataatatttaataatatatgtatgtgtgataacacatttatataatgtccattaccatgtggtatatatgcttatccatttgtctgtcgatggacacttgagttgctccccygctttggctactgtgaataatatgactgtgatcatggatatgcaaatatttccttaagtctttcagttcttttgggtatatacccagaagtggaattgctggatcatatggcagttctatttttaattttttgaggaaccactgtactgttttccatgtagactgcataagaattccaatttttccacatcttgccaacgtttatttttatttatttctttaaattttttatagtagctatccattctaatggatgtgaggtggtatctcattatggttttgatgggacttttgagtttt

SEQ ID NO: 338 - DNA, 601 bp, Human
ttttttttttgacagagtcttgctctgtcacccaggctggggtgcagtggcgtgatctcagctcactgcaacctctgcctcccaggttcaagcagttctcctgcctcagcctcccaagtagctgggattacaggtgtctgccaccacactcggctaatttttatatttttagtagggacaaagtttcatcatgttattcaaattcctgacctcaagccatctgcctgccttggcctcccaaagtgctgggattacaggcgtgagtcactgtgctcagccagttgcactacattttttttttagatgccattgttgaggatccaggggtttgtcatagattgattaatcagaaagtattaatctaaagtattagaatatattgattgcaggcagggaccttgcatagtttaaagatgactcagaaggcacattaggttcttgccacactttgctgccatcacagatggatgtgagttgcccccttatataggtctctcgggatgccccagtggagaacagcattgatgttgaacagatcctgtccgatggagagataccagcgtttcagccagcggtgtgagtgagggcaggggccacctct

SEQ ID NO: 339 - DNA, 601 bp, Human
aaaccttatgtaagatgatggtgagtttggactttccagtaacatttggaaactgtttagtaccaagctctcattaacaatataaacaaaataggggtctacccttaaggaatcaaagccattatctaaaagctctttcccgcaacaactacctgagataatgtccttggtcatatgccccagcatttaaaaatggagttagtgagagtctgttgtttaccacctgatacattggtaagagctgcttgatggtatggggacatcagtagggaggatatagacgtagccacccccgccctasatagtaggggcctcagggtggggtaagcctgggtgggggaggtatgagtggtggaacagtgggagaccctggatccttagtctccagcgtgattgcattttgccaaggctttgtcccatgtccctttgtcccgtgttccatttgcccgtggtgttgcctagagagcatggaggggctggtggagcatgctctgtggttccctaacccagggctgtgtggggagagcttgcagcacccccctgaccccatatgaacgtccttgctatttcctgctgtgccatccagcaactataggatgct

SEQ ID NO: 340 - DNA, 601 bp, Human
tatgccccagcatttaaaaatggagttagtgagagtctgttgtttaccacctgatacattggtaagagctgcttgatggtatggggacatcagtagggaggatatagacgtagccacccccgccctagatagtaggggcctcagggtggggtaagcctgggtgggggaggtatgagtggtggaacagtgggagaccctggatccttagtctccagcgtgattgcattttgccaaggctttgtcccatgtccctttgtcccgtgttccatttgcccgtggtgttgcctagagagcatggagrggctggtggagcatgctctgtggttccctaacccagggctgtgtggggagagcttgcagcacccccctgaccccatatgaacgtccttgctatttcctgctgtgccatccagcaactataggatgctgtgctgtggctgggagacctgtttggtcttggaagctgggtcctggatgagcagaatgaggcaggcatagaggtgatgttggctacgggcaggggagcatttgctttgccttggagtagtgccatttccatgtagaggggcaagatttaccaccctgttgtggggatttgaga

SEQ ID NO: 341 - DNA, 601 bp, Human
cctgctgtgccatccagcaactataggatgctgtgctgtggctgggagacctgtttggtcttggaagctgggtcctggatgagcagaatgaggcaggcatagaggtgatgttggctacgggcaggggagcatttgctttgccttggagtagtgccatttccatgtagaggggcaagatttaccaccctgttgtggggatttgagactttgggttttgttttcctttacaccttgagctttgttctacagcaggtccctgggaagactggtccacaaagctgctgaatggggctgctgtccwtcagccctgcctcctgctgcagaatgcagaggacgctgtagacttgcttggtgggtgcctggggttttctgcctccctggtgcactgggcacagcggcttgcctgccttttgggtcgtctccacctcccagggatgtttttgttccctgatcgaatgacctcctgttttgtttgttttttgagacggagttttgctttgtcacccaggctggagtgcaatggcatgatctcggctaactgcaacctctgcctcccgggttcaagtgattcttgtgcttcagccttctgagtagctgggac

SEQ ID NO: 342 - DNA, 601 bp, Human
ctgctgtgccatccagcaactataggatgctgtgctgtggctgggagacctgtttggtcttggaagctgggtcctggatgagcagaatgaggcaggcatagaggtgatgttggctacgggcaggggagcatttgctttgccttggagtagtgccatttccatgtagaggggcaagatttaccaccctgttgtggggatttgagactttgggttttgttttcctttacaccttgagctttgttctacagcaggtccctgggaagactggtccacaaagctgctgaatggggctgctgtcctkcagccctgcctcctgctgcagaatgcagaggacgctgtagacttgcttggtgggtgcctggggttttctgcctccctggtgcactgggcacagcggcttgcctgccttttgggtcgtctccacctcccagggatgtttttgttccctgatcgaatgacctcctgttttgtttgttttttgagacggagttttgctttgtcacccaggctggagtgcaatggcatgatctcggctaactgcaacctctgcctcccgggttcaagtgattcttgtgcttcagccttctgagtagctgggact

SEQ ID NO: 343 - DNA, 601 bp, Human
atttgagactttgggttttgttttcctttacaccttgagctttgttctacagcaggtccctgggaagactggtccacaaagctgctgaatggggctgctgtccttcagccctgcctcctgctgcagaatgcagaggacgctgtagacttgcttggtgggtgcctggggttttctgcctccctggtgcactgggcacagcggcttgcctgccttttgggtcgtctccacctcccagggatgtttttgttccctgatcgaatgacctcctgttttgtttgttttttgagacggagttttgctytgtcacccaggctggagtgcaatggcatgatctcggctaactgcaacctctgcctcccgggttcaagtgattcttgtgcttcagccttctgagtagctgggacttcaggtgtatgccaccatgccacgctcatttttgtatttttagtagagatggggttttaccatgttggtcaggctggtctcgaactcctggcctcaagcagtgcgcctgcctcagcctcccaaagtgctgggattacaggcgtgagccaccgtgcctggcctgacctcctgtcttctgtttttgcccactgtcaag

SEQ ID NO: 344 - DNA, 601 bp, Human
cagtgtttttcttctgtttttgcctttggctgataccactgctagagtgcagataagagaatgttactaccagggggcttgagtgtcgggctatgattggctgtcatctggagcagagtgggactgagctgctcaggagaaaggtcttcaggtgattttttttgggaagctaagagcactggttttagacatcctctcctggctgatgatgggattggccttcatggggctgctgtctggctgggctggtgggcagaggttcctgtgggtgtggatggagaaatcctaaatgccgagggtrcctggtcttagtagaaatcgtaggatgcctcagtgaagaagtcagggatgcggattgtcctccggatgcttggatgagcgtgcagtggaaaaagtactcctttgggggaagaggtgaatctggaggtgttagagcagaagagtaaatgcagaagttgtagcagatacaaaggctttggcaagagtgggagtgatcattgaagggaaggcaggggcttgctgggacaggctggagccgtgatggaccctcatagtaaccctgctgcattttacaaaggaagaactgtgttggggtacagat

SEQ ID NO: 345 - DNA, 601 bp, Human
ccatttccctggggagtcagtgcagcactcctgggggacccttctgtttgtgtcctgacgaatctgactgtgctggatgcagtcccacagccacacctggtatgggtggcatctttaaaggcctggcctgtgtgtgctgtatctgcagcagagctgtggccaaacctgctttccttccatctgggttccccttggttctcggtggtggacgggctgtgtggtctcccctcagctgtccacttgcacttgtgttaaaatgcggcagaactttccctctatacttaaattgtggtgaaatacrtatgacataaaacttaccatcttaacttttttttattgagacaggttctcattctgtcacccaggctggagtttttttattgagacaggatctcattctgtcacccaggctggagtgcggtggcgcgatctctgctcactgcaacctctgcctcctgggttcaggcgattctcatgcctcagccacccgagtagctggaattacacgcgcccgccaccatgcctggctaacttttgtattgttagagatggggtttcgccatgttggccaggccggtcttgaattcctggcctcaagtga

SEQ ID NO: 346 - DNA, 601 bp, Human
acgggctgtgtggtctcccctcagctgtccacttgcacttgtgttaaaatgcggcagaactttccctctatacttaaattgtggtgaaatacgtatgacataaaacttaccatcttaacttttttttattgagacaggttctcattctgtcacccaggctggagtttttttattgagacaggatctcattctgtcacccaggctggagtgcggtggcgcgatctctgctcactgcaacctctgcctcctgggttcaggcgattctcatgcctcagccacccgagtagctggaattacacgygcccgccaccatgcctggctaacttttgtattgttagagatggggtttcgccatgttggccaggccggtcttgaattcctggcctcaagtgatccccctgcttcggcctcccgaagtgctgagattacaggcgtgagccgccgcgcctggccttccttttttttttttttttaagagatggagtcttgctctgtcgcccaggctggagtgccgtggtgcgatcttggctcactgcaacctctgcctcccaggttgaagtgattcttctgcctcagcctcccgagtacctgggattacagg

SEQ ID NO: 347 - DNA, 601 bp, Human
gctcactgcaacctctgcctcccaggttgaagtgattcttctgcctcagcctcccgagtacctgggattacaggcgccaggcaccatgcctggctaatttttgtatttttagtggagatggggtttcaccatgttggccaggctggtcttgaactcctgacctcgtgatccgcctgcctcggcctcccaaagtgctgggatcacaggtgtgagccaccacgcccaccggcctcccatcttaacattttaaagtgttcagtttaagtacctttacactgctgtccaatcaatctctagaacrcttttcatcttgaaaaacggaaactctgtacccattaataactcccattctctcctaccacagccacgggcagccactttctgctgtctccgtgagtctgactactttgagtacctatgagcagaatccgcaggatttctccttttgtgactgccttatttcacttagcataatgtcctcaagctccatccaggttgttgcatgtgagaggatttccttcctgtgcatgaactagagtgatgcagggactgacctctggccatgtgatgggtggttggtgatggatccaagaggtagctg

SEQ ID NO: 348 - DNA, 601 bp, Human
tgcctggctaatttttgtatttttagtggagatggggtttcaccatgttggccaggctggtcttgaactcctgacctcgtgatccgcctgcctcggcctcccaaagtgctgggatcacaggtgtgagccaccacgcccaccggcctcccatcttaacattttaaagtgttcagtttaagtacctttacactgctgtccaatcaatctctagaacacttttcatcttgaaaaacggaaactctgtacccattaataactcccattctctcctaccacagccacgggcagccactttctgctktctccgtgagtctgactactttgagtacctatgagcagaatccgcaggatttctccttttgtgactgccttatttcacttagcataatgtcctcaagctccatccaggttgttgcatgtgagaggatttccttcctgtgcatgaactagagtgatgcagggactgacctctggccatgtgatgggtggttggtgatggatccaagaggtagctggtctctgaatactagcccagtccttttccttgctaggaaagtccccagatcagatagaaagcctcagtatttcaagaagcttctgt

SEQ ID NO: 349 - DNA, 601 bp, Human
gttgggggacagttgggggaatagttgaagctaaggtgtttaggcagagctctgaggaggtgacgtttgagtggagacccagatggctagagaatggggcagcctcctgaaggagcagaagcactgtgggcggcagggtatcacagaggaggagctcggtgtgttggaggttggtgagtcccgtggagtcttgtcagatggtgttgggacagggacggaccgtgaggaggctggatcatggggaatgtgttgctttaggccaagctggagttgatagtggctcagatcagagctaaagtartggagacacacagacattgaaagaatgatgaaattcactcattctgcgtgtgtcccatgtcatgtgtccgctgcacaccaagtactgttttaggcactggtgatataattgtgaaccaactggagctgcggtgagagagaccatgaaaagaagggccagagcggtgtcctgcagagggtggtgtaccttgggagggaagtgtgtagggttgttgaggaacagtgtgctgcacagggaggaaagacgtggggcagcattgtgggaagagcaaccaagattctcataggcttgggagcggaa

SEQ ID NO: 350 - DNA, 601 bp, Human
gtgttgctttaggccaagctggagttgatagtggctcagatcagagctaaagtagtggagacacacagacattgaaagaatgatgaaattcactcattctgcgtgtgtcccatgtcatgtgtccgctgcacaccaagtactgttttaggcactggtgatataattgtgaaccaactggagctgcggtgagagagaccatgaaaagaagggccagagcggtgtcctgcagagggtggtgtaccttgggagggaagtgtgtagggttgttgaggaacagtgtgctgcacagggaggaaagacrtggggcagcattgtgggaagagcaaccaagattctcataggcttgggagcggaagccctgaggtctgttgctggactagatatgtgaggtgtgagaggagagaagaatcaggaatgactctttgattcttaacgtgagcaactcagagaatgagagtgctgcagtttacaagcttggaaggtggattatgtggggggatgagtgagttgtttgacacctcaatggatatactcagatggatgtatacgttagagctcaaaagagtctgggccagtgacatgaatttgatcatatctagag

SEQ ID NO: 351 - DNA, 601 bp, Human
actcattctgcgtgtgtcccatgtcatgtgtccgctgcacaccaagtactgttttaggcactggtgatataattgtgaaccaactggagctgcggtgagagagaccatgaaaagaagggccagagcggtgtcctgcagagggtggtgtaccttgggagggaagtgtgtagggttgttgaggaacagtgtgctgcacagggaggaaagacgtggggcagcattgtgggaagagcaaccaagattctcataggcttgggagcggaagccctgaggtctgttgctggactagatatgtgaggtktgagaggagagaagaatcaggaatgactctttgattcttaacgtgagcaactcagagaatgagagtgctgcagtttacaagcttggaaggtggattatgtggggggatgagtgagttgtttgacacctcaatggatatactcagatggatgtatacgttagagctcaaaagagtctgggccagtgacatgaatttgatcatatctagagtatgagtggcacaggaagccacttgtctggatgaggtgacagaggaaaaggttgaggatagcaaccaacatttagaggtaaggtagaaggc

SEQ ID NO: 352 - DNA, 601 bp, Human
tgccaagtgctggtttctgctattcttttctctgtcttaggggtgtcattttctctttggtaaaacagaagaattagatgatatgaagtttcacattctaagttctcaagctttgcccactcctcagcccttgggtccctccacttcctcttctcttcgctatctctgctcagtttctgtctttgattgtaatgtaatgcccagtgggacttttcttctctccctcgtctgttcacttattccgtcctgcactgggccaccagattaatcctgcaaaaggcctcacatgggcttctctccygctcaggagccttgtgggggctttattcctctgagatgaaagttcttatccccacatgtgatcctttatgacttgggtgctatcaaattcatttcctcaactgctcccctcttcaccctgaccatcagatctgctggcacatgggcataccttgttctgcattgtctctggcctgtgggatatttaccgagctttaaatcctaggcaccctttgggagccggcctgtgtgcagagctccccttagcacggtggcacaaagcttggacaccacctcttgtctgtcctgcttaattccattc

SEQ ID NO: 353 - DNA, 601 bp, Human
gagaagctttaatagtgtacttgggattattaaatcctaaaaaaggttatcacaaagagttttcttggtgtgtgtctgtgcttagaatttagaaaataagtcatccagtattgaggccattttatgaaaagcctttaaaatctgcaaatgcgttggcccagcacttccacttctagggatttatcctaagaaaatagtcttgggtatctgccaataatgttcactggagtgttgtttataatgtgcaaaacaggagctaacctaaatgtccaacaataagggattggttaaaaaaaaaaaacaaccctcatggtgtgtattaatactctggaactactgtccccttaaaatggtgatgtagaaggacatgtattgacctagtaaaatattaagtgaaggaagtgtgtttacaaatgtcatttttgtctgatttcacttaccttcatttatagagagtggataattggcatagatagtgttaacattgtttatcgtggaatgttgagatcgttgatgatttttactggtttttttttttttggttattacctctaaactctgtaggaagcatgctttcttgatcaataaaacttaaagttgg

SEQ ID NO: 354 - DNA, 601 bp, Human
aatgtgcaaaacaggagctaacctaaatgtccaacaataagggattggttaaaaaaaaaaaacaaccctcatggtgtgtattaatactctggaactactgtccccttaaaatggtgatgtagaaggacatgtattgacctagtaaaatattaagtgaaggaagtgtgtttacaaatgtcatttttgtctgatttcacttaccttcatttatagagagtggataattggcatagatagtgttaacattgtttatcgtggaatgttgagatcgttgatgatttttactggtttttttttttttggttattacctctaaactctgtaggaagcatgctttcttgatcaataaaacttaaagttggagtttatgctgcttttattcataaaaaaatcacgtttttaatcttctgttaggttatcctttatgtctacattaatgcacgtgtggagagaacacagtctactcggcttatgtcaaatggtagtgggaagcatggaagcatgcgttttttagtccccactttacaagtcacagtgacggttctccagtgtagagtagattgattgccctgtgtccttcaggcagggtgcagtagtaagt

SEQ ID NO: 355 - DNA, 601 bp, Human
ggaaggaaaagcaccgtgaaaatgttaacgatggttagaaggtgggctctgctggtgacagacagagccttgatatcacctgttggttggtcacctgcttccccaaggccacgccctgcagccttctccttgaccatcccagccctgctgatgttccttgtgatttcacaatggagtacttatataaaattggtaactgctttccgggaaattgacttcccttccccttgtcctgaaaactcaggcatgggcatatttcttggagattttctagttgaatcagaacttcctcttggtttgygtagattccatttagacctgcattgtccagtgtggtagccgcttattgagtaagccacgtggcttattgagtacttgaactgtggcttgtccgaattgggactgctttaggtgtaaaatatacactagatttccaagacatagtatagcaaaaactctgtacaccatttcattaataattactatgttgataacatgttgaaatataacattttggatatattagattaagtaaaatgtgttcttaaatttcacctgcctgtttcctttttattcttttttttttttttttgaggcggag

SEQ ID NO: 356 - DNA, 601 bp, Human
cttggtttgcgtagattccatttagacctgcattgtccagtgtggtagccgcttattgagtaagccacgtggcttattgagtacttgaactgtggcttgtccgaattgggactgctttaggtgtaaaatatacactagatttccaagacatagtatagcaaaaactctgtacaccatttcattaataattactatgttgataacatgttgaaatataacattttggatatattagattaagtaaaatgtgttcttaaatttcacctgcctgtttcctttttattcttttttttttttttttgaggcggagtttcgctctcatcacccaggctggagtgcagcggcgcgatctcagctcactgcaacctccgtctcctgggttcaagcgattctcttgcctcagcctcccaagtagctggaattacaagcatgtgccaccatgcccgtctaatttttgtattttaactggagacggggtttcaccaccatgttggccaggctggtctcaaactcctgacctcagatgatccgcccgcctcagcctcccaaagtgttaggattacaggtgtgagccaccatgcccgactctttttaattctta

SEQ ID NO: 357 - DNA, 601 bp, Human
tattgagtaagccacgtggcttattgagtacttgaactgtggcttgtccgaattgggactgctttaggtgtaaaatatacactagatttccaagacatagtatagcaaaaactctgtacaccatttcattaataattactatgttgataacatgttgaaatataacattttggatatattagattaagtaaaatgtgttcttaaatttcacctgcctgtttcctttttattcttttttttttttttttgaggcggagtttcgctctcatcacccaggctggagtgcagcggcgcgatctcrgctcactgcaacctccgtctcctgggttcaagcgattctcttgcctcagcctcccaagtagctggaattacaagcatgtgccaccatgcccgtctaatttttgtattttaactggagacggggtttcaccaccatgttggccaggctggtctcaaactcctgacctcagatgatccgcccgcctcagcctcccaaagtgttaggattacaggtgtgagccaccatgcccgactctttttaattcttaatgtggctacttgaaaatttaaaattacagatgtggcttgcattctgtgttgg

SEQ ID NO: 358 - DNA, 601 bp, Human
ttcttttttttttttttttgaggcggagtttcgctctcatcacccaggctggagtgcagcggcgcgatctcagctcactgcaacctccgtctcctgggttcaagcgattctcttgcctcagcctcccaagtagctggaattacaagcatgtgccaccatgcccgtctaatttttgtattttaactggagacggggtttcaccaccatgttggccaggctggtctcaaactcctgacctcagatgatccgcccgcctcagcctcccaaagtgttaggattacaggtgtgagccaccatgccygactctttttaattcttaatgtggctacttgaaaatttaaaattacagatgtggcttgcattctgtgttggtaagctgctttagagcatttcttttaacaccaggagttcttcccctcatcatctttttggctgagtcgtcactgcagcgctcatagccccgcatgtacctctccagccagaacccttaggaatcatttggggagctccatgaagggcattgagtccaggcagaatggctaccttgagttcaacataagcattaagatggccattcgaaaacattaagcacagaagaatc

SEQ ID NO: 359 - DNA, 601 bp, Human
ccatgtgccactccctcccgcctgcctgctgtgtccttggccccagtggtgctctcccgtgctgaccagccggcacggctcacctggccgaactctagccttgccttttcctctcaaggatgtaaaggctctgcagatttcgggaggcctgtctcccagcacctgatgggacactttttgccccactgtaaattctgggtgtatcctccactgtatgctgtcaccccaagggcaagcactgcatctgcttagtgaaggatttattgttcggaagatacattttccccttgagcagagagtrgcgtatcctggcagtcttcggtgagccagttgtaccaggattatgaaatgcagatgtttactgtgtcattgttgctgtcattgctactgaggagtactgaccagaatcatctgcaactcttagttggcagagaggaccactatggcgggtagctcttttctttcctgccattgtggggatgattccaggccaaagatgatggagaagtatggaaatcatctgaaaggttgaagcttggcacgtgaagccattcatgactttgtaaggcagttttgctgaaggccagttctgccctgggag

SEQ ID NO: 360 - DNA, 601 bp, Human
gatggagaagtatggaaatcatctgaaaggttgaagcttggcacgtgaagccattcatgactttgtaaggcagttttgctgaaggccagttctgccctgggagggacggaggtgaatcctcctgagtacctgtggttttcttacttcctgctgaatttacctaagtgcctgttgtttgcttgctgtggaggctttctggtatttcatttcaggtgcagatgccttcactttcccacaaaaaaaaccccaacaaaacctaagaccttactgcaactaagtctccaagtactttttaacccawtgggatgaacagcctgtggtctgctcagatcaccctgagtgcgtgtgagaaggcctgggctttgccaggaaatccaggaaggcagggccgggctgtgttggaagctggcttagctggtggggcagccttatttcaattaaaagggcattgactgggagcagcagtcctggagtttgttgcatttcctattgccctcaaaatgagaaaccaggaaaatagcagattggagccttcgagaaggcagtaaatggctgtttttattgacaaaaggaaaacattttactgccatctcactgatgg

SEQ ID NO: 361 - DNA, 601 bp, Human
ctggtttcttcctgtgcttgaaaagcctctttctttgttgcgttaatacctctgtcttgctttcctcatgtgtatgccagtgtgacattctcggcagagtggggatgacgtggagcgtgtgggcccgtggttaatcttgtcctgaattgccttgctcaacttgcgtgtatagggtggttcaaaagttaagtttggctggtggtgaagttggaagcatcacttagaaacacgcctcctttgggcatatggtgtgaatcagggactctggctataaaaggtggggtctctgagcaccatcctrgttggaatgttcccctgacttggaggtagcgagagacagccaaggtgtttgttccagggaggctggtgggtgggagatgggatttttctgtctgtggcacaggcagtattaagtagagcaggctgtttaaatcacattttaagtaaaaaccaaagtgcacagatgatctgcagaacttctgggggataagaagctgctttcctcgaagaagttcacctccaaaccagcgcccatggctcagcagccagcatggcagccccaggggtacatgggacttgggcatgtgaggctggtgaggga

SEQ ID NO: 362 - DNA, 601 bp, Human
gtggtctgctctgagaagatttcttgcttcctgatctgcctgtgtgttcgtgttgcttggtctctctctctgtctctctctctctcctctttgatcctagtacatacaggcaaggtatgcagcatttaaaatgttcataactcatcaaatggcacactgatcatcatgtataatttgggaatcagggtttaagaaatttagagatcatttatatggaagaaggaaccccaagtagaaacccaaaatctagaccattctgggttctaatctgtacctgccactggctaacatatggctttaagctggatgttacaatgagagctggagtttcgtctgattgcacatagccttgcttttctgtctttggaaaagtagctcactgcagagccctggtaaacgtttgaactgcattgcgggagtaggcagaagaacagaacagtccttggagcttggtaggaggtgtgagggcttatgggggacagttgtcttttcaagtcaaggaggaataagggcttctggggccggtggaaagggtgagtcttaggcagggaagggtgaccatccaggttagatcacttcttctgcggggtcagcttggccg

SEQ ID NO: 363 - DNA, 601 bp, Human
tccccatggcatattaacagcgagatctgcaagaatacatcattttgtacagaacaggatgtatttcttttaaactacgttcctgtgtggacaagtggtatcatatgcaaaggtttaaggaccgttgatgccttgagatagtgccatctgtttgcctcaggtatgtggtgctaggacaaagctgccagacctcaccttccttcagtgagacaggaataggacagtatttgaaaagcatctaacatgtttccaagcacataggtttttggtaaatggtggcagctgctgctattttttttttaaattaaactatctaagagttgcattctgagaccatctaaaattctgagtcttaagctgtgttgactatatatgttcactaccataactaaatggtccttctgtattgcttttctaaattgtagaatttcaattattgtaaatagcgggccatactgtaggtgtggttcttgctaatttgattcgtactgttcaaattcttgtgtctgtccagataaactgtatctttacagaacattcagcgaggtacatatgtctatatcggggtgccagtggagtcaccctagtcatatgtaaactc

SEQ ID NO: 364 - DNA, 601 bp, Human
catgtcatgatttttgtgaagcgaggacttggggtcccaagtctaggttttaggttccctgctgtaacccgtggccaccgagagagagttttatgataaaatgtcagcaaagtacctgacaacgtctcacgctagaatgagtttcgtacatgtttagttccctctctttttattccacgctcccccaccccaactttaaatcagaaacgtgagggtgctgattgaagctttttataacttttcttattgagaattgttctctggagttgtctccaagaacaaaggaattccagacgttctycttctctccttgtctcttctgtcctccagtcaaagaaaaactctgcatatgatctttggcctggagaaatattaaatctatgttaagtatgcagacatgaatgggcaaatgaaggatttgtggcaaagaagatctgccgaaacaaataagtcatgtaaatgggcagagggaaatattaaattgattgcatctttcagctcctggtacttaatgcaaagataaagtagtgggaaaaggttgtcatttgaaataatggaaagatgagggagttttgaagctagctgggatttttctgcctgt

SEQ ID NO: 365 - DNA, 601 bp, Human
aatattttgagaaaatggaaataattaaatttacatttcttctaggactttattttgttatcctttaaggttattgtaaatgaggagacttttgaactcacagactaaagcaaactacaccagataatcattaactttttctattgtgtgccacccttcccaaccagattgttccatagtatcacttatgaaccaagaacctgtgagcttgcaaaacgcatttttaaggagtctcaacttttctgatttgtgttaaagtttaggtgtgggtcccagaaatgagtttcatggaggggagagsttgtctctctgggtgggtaatacaggggccactgggggctcactgtggctttctggcacagacagttatgaagcaggggttactaaagtgggagagagcagccagttctccagcagccccagtgagagctctcatggatctgcctattgcactggggtaggagccatcaccgtcagcttttctctggcccacagtgccattttctgattaagctgagacctctgtaatagacacgttgtcattttttcttgtgtctaaaagtttgcttgactgcagtgggtctccagctcagagcaggtc

SEQ ID NO: 366 - DNA, 601 bp, Human
taaggttattgtaaatgaggagacttttgaactcacagactaaagcaaactacaccagataatcattaactttttctattgtgtgccacccttcccaaccagattgttccatagtatcacttatgaaccaagaacctgtgagcttgcaaaacgcatttttaaggagtctcaacttttctgatttgtgttaaagtttaggtgtgggtcccagaaatgagtttcatggaggggagagcttgtctctctgggtgggtaatacaggggccactgggggctcactgtggctttctggcacagacakttatgaagcaggggttactaaagtgggagagagcagccagttctccagcagccccagtgagagctctcatggatctgcctattgcactggggtaggagccatcaccgtcagcttttctctggcccacagtgccattttctgattaagctgagacctctgtaatagacacgttgtcattttttcttgtgtctaaaagtttgcttgactgcagtgggtctccagctcagagcaggtctggctagagaaaacaggaggtgatgactggagcactttgcccttatggaacgtgctctgatgtag

SEQ ID NO: 367 - DNA, 601 bp, Human
gaggagacttttgaactcacagactaaagcaaactacaccagataatcattaactttttctattgtgtgccacccttcccaaccagattgttccatagtatcacttatgaaccaagaacctgtgagcttgcaaaacgcatttttaaggagtctcaacttttctgatttgtgttaaagtttaggtgtgggtcccagaaatgagtttcatggaggggagagcttgtctctctgggtgggtaatacaggggccactgggggctcactgtggctttctggcacagacagttatgaagcaggggtkactaaagtgggagagagcagccagttctccagcagccccagtgagagctctcatggatctgcctattgcactggggtaggagccatcaccgtcagcttttctctggcccacagtgccattttctgattaagctgagacctctgtaatagacacgttgtcattttttcttgtgtctaaaagtttgcttgactgcagtgggtctccagctcagagcaggtctggctagagaaaacaggaggtgatgactggagcactttgcccttatggaacgtgctctgatgtagaaagcaagaggatttt

SEQ ID NO: 368 - DNA, 601 bp, Human
cactgaaggtaccttgtgtacacagaaagaagacagagggagccccggatgcctcggtatccctcagagccggatccttcagacctgtgcagtacctgtggatttggttagtcgatgatgcgctgccattaaaacaaaggcatcggccctggaatagagaagttcagtgagaacctctgtactccatgggcattttctaggaaataatttcacctgccctgtgtaattctctggaagaatcacagtgagttggaaggaaacttaagacttggaaaaggattgagaggttagcccagaccayaccagggctctgaaggcccagctggggttagaacctgggacaccctccagcccactgtctcctgttccctggccatttactgccccactcccctttctactctcaggggccctggatctaatgaggggattcgtgcagtttgctgcactaatacattgcaagtggtgccaacctaaaggtattctgatggtggaatcagagcagtagcatcttattaggtcagaatctgtatctcctcttccaagatttttacatgatttagtgttttctgaattggaaaaaaacaaaaacaaaaacaca

SEQ ID NO: 369 - DNA, 601 bp, Human
gatgaagatccttgtaccagtgaactgaccccactccccgtctggattcctgtggtgattaccctctgtattagtctgttttcatgctgctgataaagacgtacccaagactgtgaagaaaaagaggttttaattggacttacaattccacatggctggggaggcctcagaatcatggcaggaggcaaaaggtacttcttacatggtggcagcaagagaaaatgtggaagaagcaaaagtggaaaccctgataaacccatcagatctcgtcagacttattcactatcatgagaatagcacrggaaagaccagccctcatgattcaattacctcacctgggtccttcccataacacatgaaaattctgggagacacaattcaagttgagatttgggcggggacacagccaaatcatatcaccctcttagcaaggactgtgttcgtgatcatgactggcattcactgaacaatgactaggtgccaggcacctcgccagtattctttaatctttgcacagtctgtagggtggatatggatattactgttccattttttgtggaagaggaaatggaggcaagagacctgattataacttgtgcaa

SEQ ID NO: 370 - DNA, 601 bp, Human
tggattcctgtggtgattaccctctgtattagtctgttttcatgctgctgataaagacgtacccaagactgtgaagaaaaagaggttttaattggacttacaattccacatggctggggaggcctcagaatcatggcaggaggcaaaaggtacttcttacatggtggcagcaagagaaaatgtggaagaagcaaaagtggaaaccctgataaacccatcagatctcgtcagacttattcactatcatgagaatagcacaggaaagaccagccctcatgattcaattacctcacctgggtcyttcccataacacatgaaaattctgggagacacaattcaagttgagatttgggcggggacacagccaaatcatatcaccctcttagcaaggactgtgttcgtgatcatgactggcattcactgaacaatgactaggtgccaggcacctcgccagtattctttaatctttgcacagtctgtagggtggatatggatattactgttccattttttgtggaagaggaaatggaggcaagagacctgattataacttgtgcaaggtgccatgcagctaagcagccagcccaaatccagacctgct

SEQ ID NO: 371 - DNA, 601 bp, Human
tctgtaagtttttaagtggcttcctttcctctggtggagaagccagcacctttatcctatgacaagaaagctctttgtagtaggtggtagtagaatcagacagatctggcttaaaatcttggctgtgctacctcttggctctgcacattggtgaagagaatttaccttcctaaggcctctcagctacacgactgtggacactcagcttccttctaaggtcgttgtgagaggtaaagaaaaggggttagtccagggccagacatggcacaatgcctcaatgaaatattagctgatactatcrtaatttttaaattcccataggactcactgttaaaggattacaaggctgacacaaaaaatactgcattttgaatttgtgtctgatttatacatttccaaagagtggaattctcactacaacagctgttctttgaaaggttagatctttgttctgagataaattaagtggaaaaaggtgtagagcattatatgtactctgattcttcagggcttaatttaaaaagagcatgtttgctggtgaatgctggttcaatcattaagaagtttttgagaaggaatcccagaaagtaataagcactta

SEQ ID NO: 372 - DNA, 601 bp, Human
tgtgtctgatttatacatttccaaagagtggaattctcactacaacagctgttctttgaaaggttagatctttgttctgagataaattaagtggaaaaaggtgtagagcattatatgtactctgattcttcagggcttaatttaaaaagagcatgtttgctggtgaatgctggttcaatcattaagaagtttttgagaaggaatcccagaaagtaataagcacttatttttcatggaaaggaaccggaagtgcttggtgacctccacaggtaatcttgtattatttttgcactgtttggarttttttaaccatgtgcttttatttcttctattcttttcaaaggtcagtaggtgttatctggacaatagggttctggtctgttttctgttttcttcattgtactgtgcattaagaaaaaccctaatgtgcttttttttttttttaagtgaacctttccacatctcattgtccttcagtgagagcaggctgtgtgtgtggtcttggtgaactgtcccgttccctggagacagtatctgggggcctccctgcccttcccagtaagagctgggccttcacaggaatagaggcctaggattcgcc

SEQ ID NO: 373 - DNA, 601 bp, Human
aaaaagagcatgtttgctggtgaatgctggttcaatcattaagaagtttttgagaaggaatcccagaaagtaataagcacttatttttcatggaaaggaaccggaagtgcttggtgacctccacaggtaatcttgtattatttttgcactgtttggaattttttaaccatgtgcttttatttcttctattcttttcaaaggtcagtaggtgttatctggacaatagggttctggtctgttttctgttttcttcattgtactgtgcattaagaaaaaccctaatgtgcttttttttttttttaagtgaacctttccacatctcattgtccttcagtgagagcaggctgtgtgtgtggtcttggtgaactgtcccgttccctggagacagtatctgggggcctccctgcccttcccagtaagagctgggccttcacaggaatagaggcctaggattcgccttcatcctcttgaagagccctaacagtaggtcctggctggggtctggcatagaatgcccttggcacgatgtgtgtgagtgtgtctttccttagtaaatggccttgaaaatgccatgtgcttctggcaggcctggataaggttt

SEQ ID NO: 374 - DNA, 601 bp, Human
ggttctggtctgttttctgttttcttcattgtactgtgcattaagaaaaaccctaatgtgcttttttttttttttaagtgaacctttccacatctcattgtccttcagtgagagcaggctgtgtgtgtggtcttggtgaactgtcccgttccctggagacagtatctgggggcctccctgcccttcccagtaagagctgggccttcacaggaatagaggcctaggattcgccttcatcctcttgaagagccctaacagtaggtcctggctggggtctggcatagaatgcccttggcacgaygtgtgtgagtgtgtctttccttagtaaatggccttgaaaatgccatgtgcttctggcaggcctggataaggtttgccctgcataacccttggaaagcacagttctcacttgtaacaccctgtctgcaggtccatgatattgtaattaaaaagttatgggatcacaagggcctatttaaagggcatctggtctaaaggcacagttaaaagcagaatttgtgtcagtggctcccttaatttctcaaatatggttctgtttctaaattcatcccactggatgtctgtgttgagttttctgttg

SEQ ID NO: 375 - DNA, 601 bp, Human
agaaaaaccctaatgtgcttttttttttttttaagtgaacctttccacatctcattgtccttcagtgagagcaggctgtgtgtgtggtcttggtgaactgtcccgttccctggagacagtatctgggggcctccctgcccttcccagtaagagctgggccttcacaggaatagaggcctaggattcgccttcatcctcttgaagagccctaacagtaggtcctggctggggtctggcatagaatgcccttggcacgatgtgtgtgagtgtgtctttccttagtaaatggccttgaaaatgycatgtgcttctggcaggcctggataaggtttgccctgcataacccttggaaagcacagttctcacttgtaacaccctgtctgcaggtccatgatattgtaattaaaaagttatgggatcacaagggcctatttaaagggcatctggtctaaaggcacagttaaaagcagaatttgtgtcagtggctcccttaatttctcaaatatggttctgtttctaaattcatcccactggatgtctgtgttgagttttctgttgatgaaagaatgtttaaaaatgaggcagatccaaattctaatgt

SEQ ID NO: 376 - DNA, 601 bp, Human
aggagaaaatgtggatattcaagaaagagggtcgcaaaatagcaaacacccactatggctgggcagtacagggttgcagaaatatattttgatgtgtgatcgcattggagctacttcaaagagcaaacacaccactttgatttatttctcttagtgatacagtatttagagagggagatactttttatcttcatgggatacttacagtggtgctctagaagccatgtactgcttctggcttctccttcctttcctccaaggctcctcctgcctcctcccaaagctctgtgccctgaaagakccttgagccattgctcagatgtcaaaattgtattaagcagacacatcaaattaaaacttttgggatcactcaccaatatggtttcctgtacagtactgccctgaggggggattacaagtagttatgcatccatttcattgatgtatcatttttattaaaaagaaaaacaatccaaccaagagaggaagtgtagccagctgcctaaagagtggcgatgatgggagatgatattttgattacattaatccatatcctgttagttcactttgcttctgtcgctgctgctggtgaagttactaa

SEQ ID NO: 377 - DNA, 601 bp, Human
gggactgttggtgtcaggcacacaccaccttgcctagcttgaagatctttcttctaaatgagcgggctttaaagtgatcagtgggacctgggcaggttggctcttgcctataatccaagtgctttgagagaccgagacaggaacatcacttgagcccaggagttcgaggctaaagtgagctgtgagcacaccagtgcaccccagcctgggcaacagagtgagactctgccccaaagcaagataaaattatcccacaggattttagtcctgacttgtgtattactatgcagttgtgtctgtstgaggctcagattcccccccatttaggatttgtgtggctaaatctcagatctcattttcaggtgaatttctctattaaggttataaaagaccaaaataactggaaattcaactctgtacttgaatacttggtaatgcccagcattctcttgactatcccatttcacagtttgccggtcatttccccagtgtactcactggattcttcccgcagccatgaaaggtaggtataattaactccagtttacattcaggacaatagaatgttcgtcaaaatgcttttgcacatgttttctcaccc

SEQ ID NO: 378 - DNA, 601 bp, Human
tggttcacctgacattcagctgggttgggggagaacctctttaaacatcagatcttattccggaggagtgtatccagccttctcacagcatatcctgttaaatatctgttcaaggttagcctaggcctggagtatggacagcatgaagccagatctaaaacagatcagttcatggataaatgatgaatttaataaaatttgaaaataaaccccacataactagtgctgctattgatcattcatatagccagcaggagtggtgagaggcttggtctgcctgaggtgtggagatgcttgtggyggggggcaaggtggacgagggctggggctgctcctggagcatctttacgcgggtggaggagctctgacacagtggcagtgtttgtaacactttccaaagggattaaaataattctgtagagttaaccctaggctagtgtggcttgatctgaaacagtcccagccagaaggtaagaactcctgtgttatgttgttagcatacaatttgctgaagttcacattttaaattttatatttaaaaaccaaaaagtagtactgatcattttggactgtttcaaagtgatattgtttttacttgtta

SEQ ID NO: 379 - DNA, 601 bp, Human
ctcacaatgggccggatgtggtggcttacacctgtaatcctagcactttgggaggctgaggcgggtggatcacctgaggtcagaagtttgacaccaacatggtgaaaccccgtctctactaaaaatacaagaattagccaggcttggtggtgggtgcctgtaatcccagcttctcgggaggctgagacaggagaatcacttgaacctgggaggaggaggttgcagtgagccaagattgtgtcattgcactccagcgagtgcagtgtaaatcccttaaggaaacagtgtgttgtggtaatcrtgatatcatagtaaataggttttgttcgttatttttttcttttacttccttttctaccagtgactagtcctaatgtgttctaacttttgaaaataaagtacaaattagatggatttaaacatacgggaagtaagacggaaattcattacttttaaaaaacaatttgttgtggataagatttagaaatggaaacacaataaactgtgtttccatgacacaggtatactaccaagttcttacaatgtacctttgaggtaacgaattttcatgtcatttggagtagggctgggccagtgagtc

SEQ ID NO: 380 - DNA, 601 bp, Human
tggcttggatgacaactatggcaatgcccattactgagctaggagatgctggaggaagatcaggtggggactgtgagcatgagtttgatttttgcagatactgggtttgagacacttctgagtcaagcaggcatttggaaatgtggactggtgccgagaaggaattcccagcagtgacttggtttaggtggtcctggaaagtagaaacacacacgagataattctggggatggagcttaaagggacgtcagcgttcaagggccaggtagaggatcatgagctgtaaagggacccaggtggytccagcacagcgaggaaagcatgcgagtgtgatggccaggcttccagggagagaggagggttttaaggagaacaacgtgctaaaagccactaagaagccaagcagagtgagaaatgaagacctccactgggtcttgcaagaggggaggcctttgaggacctcacctgagagctgatgaatgaagtgatggctggaagcagctctggagagggaggaatactgtggggaggggaggaactgaagaagtagagaagcatggctgtgcacaggggaggtgggatggcagccagggaggagcag

SEQ ID NO: 381 - DNA, 601 bp, Human
tcggcctcccaaagtgctgggattacagccactgtgccctggcactactcaatttgtaataaatcagggtaagttatttttggtgccaagtcgattaattgaatataggttattttgcatcttagattccctctgacgactaaatcttataagcagaggtatgtgagcatgagaactgtgtcgggtggtcctgaagagattagtggattagaaggagatttggagatttttaaaaaagcctctggacagtgagttaaatggtgggttgacactctgtggtcgggactttttggagagtctrtaaagttctgctgtatttctcaagagctagagagagatgatactatgaccaaatttggtttgaatgtattataatgtactgagtatcactaatttgttgggaaatgactgttaaaaatacttactgacgcttaaaaatatcacctatagcattagtataagtagccaactgatttacatatatttcatgtgtgtgttgggagaggggtgtggattcgttaggccaaagatttcggtaatatatttggaagagataaatgaagataaagagataaattaccttttgaataattccaaaact

SEQ ID NO: 382 - DNA, 601 bp, Human
tttcatttttctaagtttccattagctatcatggcctcacttgttatttcataatgaatggttacaaattgtttgtgtgtttttgtaattagaatgtaatagcaatcgtctaccagatgagctgacattgtaatgacatgaagtcagtaacaattatgccttacaggaaaattaattctgtaatcctatcatcccatattttgcctaagagattcgatttggctgctgctaggctgcttaggcaggtgacagcatggtgggacacttctcatttttctggttagactacttaaccataacrttcatggtgccacctgaaaaaataattttatcgttttagacttttaaaatatttttaggctttttttttttttggcttaaaaaaagaatctgttctacttgggtattttgttctccttatttcttagtgaacaaagatatttgctcgacttctatcccagaaggaccatcctttcttcttccttttccttacctctaagggatatgaagctgtgagagggaattgcatatagcaataccattttgattccagtgaaagttcttacctttctcttttgtcattctcaacctcttacctgaa

SEQ ID NO: 383 - DNA, 601 bp, Human
ttacaaattgtttgtgtgtttttgtaattagaatgtaatagcaatcgtctaccagatgagctgacattgtaatgacatgaagtcagtaacaattatgccttacaggaaaattaattctgtaatcctatcatcccatattttgcctaagagattcgatttggctgctgctaggctgcttaggcaggtgacagcatggtgggacacttctcatttttctggttagactacttaaccataacattcatggtgccacctgaaaaaataattttatcgttttagacttttaaaatatttttaggctttttttttttttggcttaaaaaaagaatctgttctacttgggtattttgttctccttatttcttagtgaacaaagatatttgctcgacttctatcccagaaggaccatcctttcttcttccttttccttacctctaagggatatgaagctgtgagagggaattgcatatagcaataccattttgattccagtgaaagttcttacctttctcttttgtcattctcaacctcttacctgaagagtccattccctcagtatatagagcatctggaagtctaaggtgcaggcaggactgaaaga

SEQ ID NO: 384 - DNA, 601 bp, Human
acccaggttggagtgcaatggcgtgatcactactcactgcagcctctacctactcaggctcaggtgatcctcttcacctcagcctcccgagtagctgggactacaggtgtacaccaccatggccagctaatttttgtgttttttttgtagagacagggtttcatcatgttgcccaggctcatctcaaactcctggcctcaagtgatccacccacctcggcctcccaaagtcctgggattacaggcgtgagccatcatgcccggccttcttctagatgtttaaaacaaacacattttagtgyagttgagcctctgatcgttacatgtttatttcctagcatttaaaagcctttcagcgacatacactccttattagcttaattttttcttttaagagccgtgttcttgctctgtcacccaggctggggtgcagtggtaccatcgtaactcactgaagccttgagctcctggcttaagtgctcttcccaccttaaccttctgattaactaggattacaggtgtgcatcaccacgcccaggtaatttctaaaaaaaaaagttttttgtagaagtgatgcctcgccatgttgcccaggtgtctgt

SEQ ID NO: 385 - DNA, 601 bp, Human
ggactacaggtgtacaccaccatggccagctaatttttgtgttttttttgtagagacagggtttcatcatgttgcccaggctcatctcaaactcctggcctcaagtgatccacccacctcggcctcccaaagtcctgggattacaggcgtgagccatcatgcccggccttcttctagatgtttaaaacaaacacattttagtgtagttgagcctctgatcgttacatgtttatttcctagcatttaaaagcctttcagcgacatacactccttattagcttaattttttcttttaagagcygtgttcttgctctgtcacccaggctggggtgcagtggtaccatcgtaactcactgaagccttgagctcctggcttaagtgctcttcccaccttaaccttctgattaactaggattacaggtgtgcatcaccacgcccaggtaatttctaaaaaaaaaagttttttgtagaagtgatgcctcgccatgttgcccaggtgtctgtcttgaatgcctggcttcaagcgatcctctcccctcaactctcaaaaggctgtaaccctgattttaatggtagtgtaaagtgacatgggatgaaggaa

SEQ ID NO: 386 - DNA, 601 bp, Human
ggttcctctgtgcagacttgtagacagtatgggttctttgcgtgctgagttgaggtggccccaaacctttcagacagttgctcagatacctggcagttgctcatttacccttccagaccttcctgcctctatattagccaatgacaagcagatgctttccacaaaacattcgtgtgtgaactgttgacatttatgactgttttctgagcccacaccaggtcatttttctataaaatcagaactgtgagagctcagggcatgtggccatcctggataatgggtcctgctgtctggggagtcrttttcatcaaaattcacttttaaagaatagagtgtttattaacgaaaatatgtgagccttggctgggcactgtggctcctgcctgtaatcccagcactttgggaggccgaggcgggtggatcacaaggccaggagatcgagaccatcctaacgcggtgaaaccccgtctctactaaaaatacaaaaaaaaagttagctgggcgtggtggcgggcacctgtaatcccagctactctggacgctgaggcaggagaatggcatgaacccgggaggcggagcttgcagtgagcggagattgtgc

SEQ ID NO: 387 - DNA, 601 bp, Human
ctcagatacctggcagttgctcatttacccttccagaccttcctgcctctatattagccaatgacaagcagatgctttccacaaaacattcgtgtgtgaactgttgacatttatgactgttttctgagcccacaccaggtcatttttctataaaatcagaactgtgagagctcagggcatgtggccatcctggataatgggtcctgctgtctggggagtcgttttcatcaaaattcacttttaaagaatagagtgtttattaacgaaaatatgtgagccttggctgggcactgtggctccygcctgtaatcccagcactttgggaggccgaggcgggtggatcacaaggccaggagatcgagaccatcctaacgcggtgaaaccccgtctctactaaaaatacaaaaaaaaagttagctgggcgtggtggcgggcacctgtaatcccagctactctggacgctgaggcaggagaatggcatgaacccgggaggcggagcttgcagtgagcggagattgtgccacttgcactccagcctgggcgacagagcgagactccgtctcaaagaaaaaaaaaaaagaaagtatgtgagccttatccc

SEQ ID NO: 388 - DNA, 601 bp, Human
ggatcagtatcaggatcgggaggtaaccaggtctccaagttttccctttcgtttttcttttctgcttttaatgagccttaattaatccagggagctaggctgcagtatctgtggctctccctgatgttttctttctgcatttctgtcttggaggggaacctgaggatttggaagtagagggctctactagtgcttcctttttgtccttttctcattgtccaaaagagtcttaagcgatctccaggaaatcccctgctcctgccaggaatctgcctgtgagtatttgagtgagttgctgctytttaagtaccagttgagaagctgaaggttggtgttgtggttgtgataaactcccaacatgaaaactgaggaccaccagcgttttcagctcacctttgactcacgctggcagctccaggaacactgaacaggagtccccactgaacctttgctgcgttccgaagcagcacagccatggttaggcactgccaggcagctcttggaaaccacagggagggaagttttggttccttctttctgtctttgtttttgagaggaatgagcttggaataaaagaacgctagtaatgactgatttgcag

SEQ ID NO: 389 - DNA, 601 bp, Human
tcactttttccattcctttaagtttattaagttgaatgcctgtctcatttgctttttagtcttcttaaaataatggcatttaaggctatacattttctttgaaaattgcttttgttacgtatttttggttttagacagttgatctcctttttgttgttttctagatggtttgtaattaaaatatttatttgatctttgattctgacattacttagaagtatgtctgtccttgaatttttcttttgcttaccttttgatattgtttatatgatttatgaatgcagctctgaggtatctgagrggatttattaacgtttacttgcgtccaagtacatgattaagttttaattgctttgtggacattaaaaaattatgcccttggtaaaatgcaaaggttttattttctgtatttagtaaatcaaacttactgattgcattatagtcagatcttccaaattcatgtatgttttcagttgtcaaattgacagttaatgatgcaccttttataatttttttttttgagacagagtttcactctgtcgcccaggctgtgtagtgcagtggcgtgatcttggctcactgcagcctctgtctcctggat

SEQ ID NO: 390 - DNA, 601 bp, Human
tatcagtacttcatccctttttatgggtgaataatagtccattgtatccagttgtatccagaagatttgcttttcattgcctaacttcagggcttcagacacctcaatctttgttctgagatggatgtaaacttaatgtatatctctctctctcacccaatgatcatgccaacaccttttttttttttttttttttttttgagacagtctcgctgtgttgcccaggctggggtgcagtcttggttcactgcaacctctgcctcccaggttcaagtgattcttgtgcctcagcctcccaagyagctggggccacaggtgtgagccaccacacctggctaatttttttttcttttctcttttttgtttttgtagagatggagtgttgccatgttggccaggctcgtctcgaactcctggcatcaagtgatctgcccgcttcagcctcccaaagtgctgggattacagacataagccaccttgcctggccatgccaacaataattatttagaagtatgttgagaatacatcccaataatagaagtgaaagctctttaaaaagaaaaatattcaaaacttaccagctgatcttatgtttcattta

SEQ ID NO: 391 - DNA, 601 bp, Human
gatttgcttttcattgcctaacttcagggcttcagacacctcaatctttgttctgagatggatgtaaacttaatgtatatctctctctctcacccaatgatcatgccaacaccttttttttttttttttttttttttgagacagtctcgctgtgttgcccaggctggggtgcagtcttggttcactgcaacctctgcctcccaggttcaagtgattcttgtgcctcagcctcccaagcagctggggccacaggtgtgagccaccacacctggctaatttttttttcttttctcttttttgkttttgtagagatggagtgttgccatgttggccaggctcgtctcgaactcctggcatcaagtgatctgcccgcttcagcctcccaaagtgctgggattacagacataagccaccttgcctggccatgccaacaataattatttagaagtatgttgagaatacatcccaataatagaagtgaaagctctttaaaaagaaaaatattcaaaacttaccagctgatcttatgtttcatttagaatggctgcattctttgcagtaccctagggttgtagaaattctcccccatgattgcacaacc

SEQ ID NO: 392 - DNA, 601 bp, Human
ctctttaaaaagaaaaatattcaaaacttaccagctgatcttatgtttcatttagaatggctgcattctttgcagtaccctagggttgtagaaattctcccccatgattgcacaacccactccttctcagccagtgtgcacctggagtcagctgtgtttggccttaaggtgtccatggtccagcagggagagggcagatgggtcagtgttgtcctgctagtgatgagtatcccatggtgggcatgctgatgccacgcaagggagagggtgtctggttctgtgcagtggcagtggtgcaacyccttaccaaggtaccgtggggacctgggttagggcaggaggaggaaggtgttctctacagactgcagggcttggaggcagcctgtcatggggaagggtgtggatgaagggtgagccgggaccccaggcaggtacggagcagttcaaggccgtcaagtgtgcttcattcttcagtcattagggtgtctctgaaaggtttttcattgaatcagaattcccctaattcacgaattctaaagcttaagtaaattcagtaataataaactgtcaattatccaagcgatgaatataaatccataag

SEQ ID NO: 393 - DNA, 601 bp, Human
cccccatgattgcacaacccactccttctcagccagtgtgcacctggagtcagctgtgtttggccttaaggtgtccatggtccagcagggagagggcagatgggtcagtgttgtcctgctagtgatgagtatcccatggtgggcatgctgatgccacgcaagggagagggtgtctggttctgtgcagtggcagtggtgcaaccccttaccaaggtaccgtggggacctgggttagggcaggaggaggaaggtgttctctacagactgcagggcttggaggcagcctgtcatggggaagggygtggatgaagggtgagccgggaccccaggcaggtacggagcagttcaaggccgtcaagtgtgcttcattcttcagtcattagggtgtctctgaaaggtttttcattgaatcagaattcccctaattcacgaattctaaagcttaagtaaattcagtaataataaactgtcaattatccaagcgatgaatataaatccataaggtttttcaaatccccagaaatccctttcatctcccacctggttttgctgagcgcctgtctcttctgtctcttttctgattcccacctttcacttttcc

SEQ ID NO: 394 - DNA, 601 bp, Human
catttctgtacctttgtggtatgtaccttgtggctaatttgtccatgaagggataggcattgtgttttgttgcttaagtcgcttaaggcctttaaagcatttccaaactcacctatttttgctctaaggggtataaggtgttaaaaaatgaatggaagttaactcattctcaccttgtctgctaacttccttttgttctttttctgtaagaactcataaagctgtatgcatcagctgctcccaggggccttctaaggcctcagtccaacaacagtgctacaggtgaggaaaggaaagaagrcactatgtcatcatgtcattcttttagacttggtaagaagtatattcaagcagatcagatgctctcagaatcacagcgtgttgtactgctagtaattaaaactgaagtccacgttgaataagaaataattttttattgattgctggcatttgtgagaaagggtttaattagaccaggatatggaggggacttatcgacagttccgttgtacattgttgacatggttattttctgtatctcattttgcctgggaatttgtcattctcttctattttcttatcagtagcactgcttttacac

SEQ ID NO: 395 - DNA, 601 bp, Human
tatttttgctctaaggggtataaggtgttaaaaaatgaatggaagttaactcattctcaccttgtctgctaacttccttttgttctttttctgtaagaactcataaagctgtatgcatcagctgctcccaggggccttctaaggcctcagtccaacaacagtgctacaggtgaggaaaggaaagaaggcactatgtcatcatgtcattcttttagacttggtaagaagtatattcaagcagatcagatgctctcagaatcacagcgtgttgtactgctagtaattaaaactgaagtccacrttgaataagaaataattttttattgattgctggcatttgtgagaaagggtttaattagaccaggatatggaggggacttatcgacagttccgttgtacattgttgacatggttattttctgtatctcattttgcctgggaatttgtcattctcttctattttcttatcagtagcactgcttttacacttattagccctagctgtttgtcttgcttatttaaacttgtacatggcacatgctcaaagatttttccaggcaaaatttctttaaagcaggatttgagattttccatccccttc

SEQ ID NO: 396 - DNA, 601 bp, Human
caccatgtcaaaattgtgtcaaaattcgtctgtatgcatttttcttggtagaagggtccccaaaagtcaccacattctcagagacttctgatccctaaaactttagatcaacagtcaataaaaaggtcccagttgtgtcttagtccccatggcagtacttttgaacatttaaaggtggagaattgctactgaggactttgttctgtggatgaaacttcgaatgaggattgttggtgagagttggattgttgttgtatgaggaagtgcaccttggaatctaatggggtcttcacggaggggragtcagttgtggcactgtttgtgtattccattcatcattcatccctccatccaagcacccacgtggagctcagaaagatgactaacacataccccctgctgctcctgtttttctaaggtgtgctgggaccatttacatttagttctttggagaacacaactacttaggatttttgttgttgttgttgttttcctgtacattgtcttcctatctcccttctggtacccattccaccctctctccccttcctcactgccgtttcataggggttctcagattcctgtgaataaagcaaaccga

SEQ ID NO: 397 - DNA, 601 bp, Human
gaggaagtgcaccttggaatctaatggggtcttcacggagggggagtcagttgtggcactgtttgtgtattccattcatcattcatccctccatccaagcacccacgtggagctcagaaagatgactaacacataccccctgctgctcctgtttttctaaggtgtgctgggaccatttacatttagttctttggagaacacaactacttaggatttttgttgttgttgttgttttcctgtacattgtcttcctatctcccttctggtacccattccaccctctctccccttcctcactgcygtttcataggggttctcagattcctgtgaataaagcaaaccgatgtgcagatatgtgtgcttacacatgtggacgtatttgaggaggtaagagggacctgcacaaggctttagtgagtaagcagagaagttatttatatatagtgagacccagtaaacggcgatgtcgcaggtgaggcagttgatctggtcagaatatgcctccagagacatcactggtgaggcctgcatgcatgttgaaaagagtgtatcttacatctaggcttgggtttccccctgcagctcacttatgaataacaac

SEQ ID NO: 398 - DNA, 601 bp, Human
agttaactactggtgatgattcttagctcatctgtggccaagtatagataagagaattagaaagttgtttccagcgtgtgaacttttatgattttcttccttggttactgtactcagttcttttttgttttgtttctatacaagatgagtagctggtggctcagatgacccccgtgctgcatgtacagtcccatccagagagtgttgggggctgtgtaaacctcgaggctcagagtggctgccattttcctaaaagagaagtatggctgctgttggcctcaatgttcagctttacaaaaaytcccgtaattaatgaaggtcaaggcatctgcaaacattaatggggtcacaagggacaaatcagttccttgaggggaagttaaaatgctagattgcttaccgctccagacaaggcattctcaagaagtatgtgcagtttcagcacaaggattaacacggagcattacttgagccatggggtgccttgggggacatggatcagcaaccatttccttttgctcacagcgcccagattttgttctggggaccactcttatctgcactgcatagcagccacacattttgagtgaaattaacccca

SEQ ID NO: 399 - DNA, 601 bp, Human
agttcttttttgttttgtttctatacaagatgagtagctggtggctcagatgacccccgtgctgcatgtacagtcccatccagagagtgttgggggctgtgtaaacctcgaggctcagagtggctgccattttcctaaaagagaagtatggctgctgttggcctcaatgttcagctttacaaaaattcccgtaattaatgaaggtcaaggcatctgcaaacattaatggggtcacaagggacaaatcagttccttgaggggaagttaaaatgctagattgcttaccgctccagacaaggcrttctcaagaagtatgtgcagtttcagcacaaggattaacacggagcattacttgagccatggggtgccttgggggacatggatcagcaaccatttccttttgctcacagcgcccagattttgttctggggaccactcttatctgcactgcatagcagccacacattttgagtgaaattaaccccaactagcattcgagcgtcctcccctcccccaaaagatggactgtaccccacactgtaatcagcagggaggcatttcctggccacagttcaggttggtcccttagaacgctgctcag

SEQ ID NO: 400 - DNA, 601 bp, Human
agctccagtaggtgtctgacgacatcttgtgatccggggggaagccagcctaaggacaaagccattgtggggtgagagacaggattggcacaatcactgacaaccgcagtagtagcccagaataaactgtgcctgaaacctaccctatttttgtattttttccagttttaaggaaataaatcccctttattgtatactcagtttgaatcaattatttttatctctttgggattggtttttggttaatctcagcaattcagaaatagctgaagaactatgctgtgggtttagacatcatgcygtgacaaaaagaagaggatcttagaagcgggggacattcactgaagctttatgagcctttcctgaatcccttcaaatcagatcaagttctctctctcctgtgcttagaaatgctgcctgttaagtcacgttggctacagcacccatctcagatcccttgtgattcagttgtaaagtagattcttctggtctgaattagaggccaaaacacaagacagatcaaaaatggggaacatattgcaaatttccccacaaaagactgaaggatgtgtttaccattgattgcacagggactgcagtg

SEQ ID NO: 401 - DNA, 601 bp, Human
cctcctctcacctgaggccacagcggtgtgcaaggatgtggtctgtcttgagtgtgttttcaaagcagctgtttggtctgtgccttggatgtttttccacagataagcccaaaagagaaccacatcttaaaacgcccgtgaccttgaatggtctttccggaggggcggctggatttgtgctctcatcgtctcaggtatgtgtcaagccactgttgtttcagagctggacacaggtgcttaggaaaattcctcactgaagggttttcaggatttacaagttcttgctgtttttgtgaccttstgtggtttctggtttcacagaaggctttgtttcttggttcttgttgctgctttcagccttggcctgtaatcactgggcgccagggagggctgcggtctgtttcccggggtgtgctcagataccgtgtcagttcacatgtgttgctgcagcggcagggggccaggcaggaggggcgggtgtcctgaagcacgctcaatttgctgatcagggccttcacttggattttgcacttgccgcagtggagacattcctcgtagctactcagtgtggtttgttttaagtgggccatccgttaattca

SEQ ID NO: 402 - DNA, 601 bp, Human
gccaaggttaaagttgagacgctgtttgttaaacctttcaaagagggaagaaggttgccttgaattcagttccagggtttgggagtctgagagggaggtggtgaggggcccggggaggccctgagaaacaaaatgctggttaaggacacagtctgctcaccgacctcggaagtctctagacgtctaaagaagtccaagcaaggaatgatgaccgaagaggaacctcaagggtgcaggcggctctgggatctcagcacatctcagtgatggaatgagctgccggggaatgacccctgtgggkgctgtccaaagtcagagcagacacaaacgtagctctccaggccccataccttggtgggcaagagggcagcaagtgcatcctcacagttgatggggagagcagcatttcagcctgcagaaaagagaaccacacagatgtaagatgaggtctgcactcacttgcctggtcatgcagagacggagctgggagcagctgcatgacttttcagagaagtggcacacgtttactgtaagggtcccaaatgtagaccactgcagatggtaaggtctagatggagggaccaatagtagggaagtaggg

SEQ ID NO: 403 - DNA, 601 bp, Human
tataataaaaaaataaataaaataaaaaaagaaaaaagaaaacttattcctgtgtcaggcacttttctaagtgctttgcagtgtattgtctcatttaatagttgtttaaattaacagagtaggccgggtgtggtggctcacatctgtaatcccagtactttgggaggctgaggcgggtggatcacctgaggttgagagttcaagaccagcctgacaaacatggagaaacctcatctctactaaaaatacaaaattagccacagtggtggcgcatgcctgtaatcccagctactcaggaggmtgaggcaggagaatcgcttgaacccgggaggtggaggttgtggagagccaagattgcatcattgcactccagcttgggcaaaaagaatgaaactctgtctcaaaaaaaaaaaaaaaaaaaaaaaagagagtaaataaaattgtaaggtgaatatgttatctacttgatggaattttttaaactaccttgaaaagttttatagtttcctatttacagatgaaattaacatactaattataaatcatgcctcactattcactttaggcagtctatctccttaaggatctccttacggtttag

SEQ ID NO: 404 - DNA, 601 bp, Human
caagctttgtctcttaaaaaacaaaacaaaacaaaatttagccgggagtcgtggcatacaattgtcatgtccacttctcaggaggctgaggtgggaggactacttgagcccaggaggtcaagactacagtgagccacatttgtgccgctgtactccagcctggatgacagagcgagaccctgtttcaaaataaagaaaaagagatttaaatgaagcgaaatgccattttctctaggtgagaaactggaatattatcaatgtcacttcttcccaaattgatttataatttaaaaacaatttyagtacttctgcagcttgtttggagcttgataaaatgattgtagagtttgtcttgaagctttaatagtgaggcaggtttaaaattgggggcaaaaaagaaatgggttttagggtgtagaagggacttgcctgatcacttttgctagaaataaatgtccctccaaattaaattactaatgtcgcacatcagatcgtatttaaatccattagaagattttactgttccattagagctacccatagctggtgaagactctgcttatagtggaacctagtttctcagttttccatttatatttat

SEQ ID NO: 405 - DNA, 601 bp, Human
acaaatagtatcctcaactcagaaggaaagaattggaacactcagctggaggtgtctggtagggacatgtgtctgctttttgaatcagtcgtatatgtttttgttcctgtgcctggaggccctttgtggtgtgagaacattgaatttggagagggaaagggagacaaaagagaaatgggggtgatgcttaagggaaagtagggtttttagtttgttcaccacgcttgatggcagatttgcctctggatcctcaggccacgttcctatggtgggtagggatctctctctctctctctctctstctctgtgtgtgtgtgtgtgtgtgtgtgtgtgtgtgtgtaaatagtgatttctctaagttaataaagaatgtggggtgacctcctacacatgcccgtatgctattgtgtaggaacaaatgcatggtaggaatgggtagactctaatctgaaagcatcaagttgtatgcatcttctgcaattaggaatctgctcaccagcacgagtgctgtggtttctgtagttctgggattcagaggagcattttaaagatgtaggatgttggaggaggaggtgcagggatctccccttgggtaaagagt

SEQ ID NO: 406 - DNA, 601 bp, Human
aaatagtatcctcaactcagaaggaaagaattggaacactcagctggaggtgtctggtagggacatgtgtctgctttttgaatcagtcgtatatgtttttgttcctgtgcctggaggccctttgtggtgtgagaacattgaatttggagagggaaagggagacaaaagagaaatgggggtgatgcttaagggaaagtagggtttttagtttgttcaccacgcttgatggcagatttgcctctggatcctcaggccacgttcctatggtgggtagggatctctctctctctctctctctctstctgtgtgtgtgtgtgtgtgtgtgtgtgtgtgtgtgtaaatagtgatttctctaagttaataaagaatgtggggtgacctcctacacatgcccgtatgctattgtgtaggaacaaatgcatggtaggaatgggtagactctaatctgaaagcatcaagttgtatgcatcttctgcaattaggaatctgctcaccagcacgagtgctgtggtttctgtagttctgggattcagaggagcattttaaagatgtaggatgttggaggaggaggtgcagggatctccccttgggtaaagagtgg

SEQ ID NO: 407 - DNA, 601 bp, Human
atagtatcctcaactcagaaggaaagaattggaacactcagctggaggtgtctggtagggacatgtgtctgctttttgaatcagtcgtatatgtttttgttcctgtgcctggaggccctttgtggtgtgagaacattgaatttggagagggaaagggagacaaaagagaaatgggggtgatgcttaagggaaagtagggtttttagtttgttcaccacgcttgatggcagatttgcctctggatcctcaggccacgttcctatggtgggtagggatctctctctctctctctctctctctstgtgtgtgtgtgtgtgtgtgtgtgtgtgtgtgtgtaaatagtgatttctctaagttaataaagaatgtggggtgacctcctacacatgcccgtatgctattgtgtaggaacaaatgcatggtaggaatgggtagactctaatctgaaagcatcaagttgtatgcatcttctgcaattaggaatctgctcaccagcacgagtgctgtggtttctgtagttctgggattcagaggagcattttaaagatgtaggatgttggaggaggaggtgcagggatctccccttgggtaaagagtggga

SEQ ID NO: 408 - DNA, 601 bp, Human
ccttgattgggctacccaaggatgcgcccgccctgctgaggtctgacagctctgggaggccagtgaggcctgtcctaatccctgttctggccggtgattcagctccaggtggaggctgtgcagaaacagccccggtcatctttgtgtgaaatacatttgtcgtcttcattttcttttttcttctgctggtatcttcatggttttcagcaaaactgtgtacattacatttttttctttaccatttctccgtagttatttctagcatttttttttcagctgatgaaagcaaatgaagaatttktatgctccatagtcagtcaaacattgatttctctgacttttaacttagaaagtcattttgcagtggcttgcgtgtgtgtatttagactgtgcttctacaaaaaagcacacgtaggcttatggctcagtttacttgttccagctcactttcctgttcatttaccttcttgtaaaatggaaagacaaacataccttaaacttaactcagatcgtgattgccaactttgttctctgtgtgtaagtagttatattattcctaggttatggcatcttgatttatctttgaaagaagaaaaccctc

SEQ ID NO: 409 - DNA, 601 bp, Human
ttagcaaatagcaagaagtctcccctttagaaaaggaaaacaagtacttaaaaaaaatcttgtgttgtcaataaacaagtccattttaaaagcatctttgaaggtgtgtaatgaaaatggaggccttaggttgtatcagggtttatgaggagccagcttatctgtaatcagatgttcctgttactgttatcactgtagtatagggcttagttctgccctttaagtcacagactcaagttactcctgattttaccagcagtcagaatacatttttctttaaaaggaaaagagacgatatccyagtgcttctctatactaaaacaggaagagaagcttccttgttgaagtgacagtttagatgttgttattttgacagaaatattagtaaatatgtcacattatcccttgctaaatatttatagcatagaacgtatactctgatgcataatattttatgaaagaaatatcttttgcctcaaatccctttcactgttttgacatgaatctataatttatacccagaggtctgcaggaaaaagactttattaagacccttttatttcagccaagataaaactccatcctaagagggaacaccctg

SEQ ID NO: 410 - DNA, 601 bp, Human
gcgggcattgtctctggcataaatgaacctctatcaaaacaaacacccagagagaggggcagcctggttacagctgcctgtgtgagcctcgacagtgggcctcattcctcacaaagggagctttgaggcccggaagaggcctttccttgatgatcgagctgtgcacagggagcaaaccccaagccgactgcttgtctgtgccaccctcaaacaatgatttccccaaattggacagcctgggtttgtatccttgagcacggttttgggaagagcattctgcatgaggcattgtagctatgtrtatggagtataattctgttttcaggttgctctgccacagaggttaagaactccctcttccaaggtagacattgagaacagagacgaccacactgggttttcactgcagcttttaaacaggatgactcccagcccccatccccgtggctagcagcaagcagggactctgaaacactgcaagccaatggactgagcatcttacttttgctgtccgtgttttggtgttttgtaaacccatctggtaatgaccctgatgccccatgtcccagcaagggcataggtacctgccattgtgcaccaa

SEQ ID NO: 411 - DNA, 601 bp, Human
cacttgaacccaggagttggaggttgcggtgagccatggctcatgcatgtaatccttgcactttgggaggctgagacgggcggatcacaaggtcaggagatcgagaccatcctggctaacacggtgaaaccccgtctccactaaaaatacaaaaaaaaaaaaaaaattagccaggcgtggttgcgggcgcctgtagtcccagctgctcgggaggctgaggcaggagaatggcttgaacccaggaggcagagcttgcagtgagccgagatcacgccactgcactccagcctgggtgacagascgaaactccatctcaaaaaaaaaaaaaaagttatttctctatgtaaacaaagaaaactctccttccttataacttgtatgtgttgggtctatttgtattctgtgaaccataagaaataagtcaactatcagctgggcgtggtggctgacgcctgtaatcccagcactttgggaggccgaggcgggcggatcacgaggtcaggagatccagaccatcctggctaacacggtgaaaccccgtgtccactaaaaatacagaaaattctctgggcgtgttggcgggcgcctgtagtcccagcta

SEQ ID NO: 412 - DNA, 601 bp, Human
gttggaggttgcggtgagccatggctcatgcatgtaatccttgcactttgggaggctgagacgggcggatcacaaggtcaggagatcgagaccatcctggctaacacggtgaaaccccgtctccactaaaaatacaaaaaaaaaaaaaaaattagccaggcgtggttgcgggcgcctgtagtcccagctgctcgggaggctgaggcaggagaatggcttgaacccaggaggcagagcttgcagtgagccgagatcacgccactgcactccagcctgggtgacagagcgaaactccatctcaaaaaaaaaaaaaaagttatttctctatgtaaacaaagaaaactctccttccttataacttgtatgtgttgggtctatttgtattctgtgaaccataagaaataagtcaactatcagctgggcgtggtggctgacgcctgtaatcccagcactttgggaggccgaggcgggcggatcacgaggtcaggagatccagaccatcctggctaacacggtgaaaccccgtgtccactaaaaatacagaaaattctctgggcgtgttggcgggcgcctgtagtcccagctactccggaggctgagg

SEQ ID NO: 413 - DNA, 601 bp, Human
taacacggtgaaaccccgtgtccactaaaaatacagaaaattctctgggcgtgttggcgggcgcctgtagtcccagctactccggaggctgaggcaggagaatggcatgagcccgggaggcggagcttgcagtgagagatcgcgccactgcagtccagcctgggtgacagagccagactctgtctcaaaaaaaataagtcaactatctcaaggtaattacccttttgaatacttgaggacatcttttctgtgccctctgaatatttccttccccagataaaatatttctagttcttttacytgttctttgtttcagagttttaagtctccatttgataaagtatagtttaatagccttcgaaaccacatcgttgagatttaaaaagccctccttgagagacatgaccagtagaaatcataccaggaccgtttagcaccctaactctgggagccatggctcttgggatgcggctgaagattgtgttatcgtcctgaagctctcttggacagctgagtcaatgactggaggtaggaaagttccttgaactctttcttgtgcccttccagctgtgagctgtgtcaccattgtattatttttaca

SEQ ID NO: 414 - DNA, 601 bp, Human
cgtgtccactaaaaatacagaaaattctctgggcgtgttggcgggcgcctgtagtcccagctactccggaggctgaggcaggagaatggcatgagcccgggaggcggagcttgcagtgagagatcgcgccactgcagtccagcctgggtgacagagccagactctgtctcaaaaaaaataagtcaactatctcaaggtaattacccttttgaatacttgaggacatcttttctgtgccctctgaatatttccttccccagataaaatatttctagttcttttacttgttctttgtttcagrgttttaagtctccatttgataaagtatagtttaatagccttcgaaaccacatcgttgagatttaaaaagccctccttgagagacatgaccagtagaaatcataccaggaccgtttagcaccctaactctgggagccatggctcttgggatgcggctgaagattgtgttatcgtcctgaagctctcttggacagctgagtcaatgactggaggtaggaaagttccttgaactctttcttgtgcccttccagctgtgagctgtgtcaccattgtattatttttacattgttgttgttcttga

SEQ ID NO: 415 - DNA, 601 bp, Human
agtctccatttgataaagtatagtttaatagccttcgaaaccacatcgttgagatttaaaaagccctccttgagagacatgaccagtagaaatcataccaggaccgtttagcaccctaactctgggagccatggctcttgggatgcggctgaagattgtgttatcgtcctgaagctctcttggacagctgagtcaatgactggaggtaggaaagttccttgaactctttcttgtgcccttccagctgtgagctgtgtcaccattgtattatttttacattgttgttgttcttgaaaaagcttttttttttttttcaaggcagagtcttactctgtcgcccaggctagagtacaatggtgcgatctcagttcactgcaatctccgcctcctggtttcaagcatttgtcctgtctcagcctccccagtagctgggattacagacgcctgccaccatgcccggctaatttttttaatttttagtagagatggggttttgccatattggccaggctggtctcaaactgctgacctcaggtgatcctcccacctcagcctcccaaagtgctgggattacaggcgtgaaccaccgtgcccggccaaa

SEQ ID NO: 416 - DNA, 601 bp, Human
cttgaaaaagcttttttttttttttcaaggcagagtcttactctgtcgcccaggctagagtacaatggtgcgatctcagttcactgcaatctccgcctcctggtttcaagcatttgtcctgtctcagcctccccagtagctgggattacagacgcctgccaccatgcccggctaatttttttaatttttagtagagatggggttttgccatattggccaggctggtctcaaactgctgacctcaggtgatcctcccacctcagcctcccaaagtgctgggattacaggcgtgaaccaccgkgcccggccaaaaaagcttttgaaaacttcgtcgtataatattatggccatccttccaaacgtgacctttttatgttgtattttatctaactaatttgcccttgcccccaacttttatcttggaatttcttacgtattaatatactgtcagggtccctgcttggggcattgtccttgggcttgtcattagataactccaagttggcttgactccagaggagctgccttcacacgtgctgtgaaatgtactgttgttgaccagagaccatcgttatcattaagtccacaaacctgcttcctg

SEQ ID NO: 417 - DNA, 601 bp, Human
tgctggtgaattggaagcttctcgtcatcccccttggctggggcgaggcttacttcctggggccttggcagttttgatctaactgacttatgttacctttctgtattaatcaagcctttttattttccatacttctgatgctttgacatcttggggccttgctgaccctgaagagaccagcccccctagggttagccagttcctaggtagtgaatgagtacaatgctcatatgcaaaataaccaatccaaaggccacgcccctcactcatatgcaaaataaccaatccaaaggccaggccycttaccacctttattgggatttcatactccaggccaatattgccctaccttaatcaccctagggccagataccaggcaagagacagcccctacaccccagagcctgtcagaattactccagccagctagtcctaaacctgcttaccttgtgtgatttattccttcccaaggaaaccacaataaaggctctcctccatgttttcctaccattccctctgcctcaggaccaaccttggttcttctccgtgtggccccttggcatggtgcactacctcttcttggggactgtgagtaacagac

SEQ ID NO: 418 - DNA, 601 bp, Human
cactatgcccagctaatttttaaattttttgtagagatgggggtctcaccgtgttgccggggttagtctcagacttctggcctcaagtgatcctcccaccttggccttccaaagtgctgggattacacgtgtgagccactgtgcccagcctgtttatatggttttaaaaacaaaaatgtatatgctctcaagatggctttcagagagcttattagtgtcttggccatttggaattccatttcacttaaattagaagagtgaaagagaaatgaatggaagaccaaaaatggggagaagaaactgtatctgatataagcgtggctctacctgggagaatggccattccgaattactggaaacaggaagaagacttgctatgatgcttccttatatctgtgggggaaaatcaaacttacattctgaaaggaaacttaatacttcatgtttttaaacacaaaaggatattttttcagagtagcagttataaagttgttagtttaatcttttagttcagctttttttcttaccagaaaaataattagtagtacaaaaatttatgcgtttgttttagctctattctgatactgttaagaagatacat

SEQ ID NO: 419 - DNA, 601 bp, Human
ctgttaagaagatacatgacataaaaacaggaatattttcagtcagtgattacaatttaaaatcatattcgaaatttaataaaaagtttaaaagaaatcaccagcataagatgttgtcatttggctcttggggcaaaccagctctcttctggtgaaagaactttctggatgaggtcgaaaggcaacagaaaacctggggaacaatggctgtctttttaatgggagttgctcctattcctggtggtaacaacctcttcctgttgctcctttccgaatggaattgcctcagtgaagttgttgaagaagtgaggagggcgaaatatgcccatccttctacagtggggagaggcctggcgcatgaaagcaggcctttgtgtatgccgggctgggcccatgcaaacagggcacaatcaggctattgtttgtttgggaaaagctatggcatcctattgcaattatttatggaagaaaatatttgatgtttttggaagaggttaggtgtggggggtgatgagggagggaggaaagagactgggcttacctcttgtcccattcactccaaatctctcagtgcgtaggatagggtccatctggtccaaag

SEQ ID NO: 420 - DNA, 601 bp, Human
tggttctggatgctgaaagtccaaggtcaggtgtcaacaaggtctggttctagtgagggctctcttcctggtttgcaaacagctaccttctcactgtatcctcatatagtggtgggagagagcaagctgtggtgtctcttcactgattaaggacattaatccaattgtatcagggtctcacccttatgacctcatttgatcttaattgtctccttaacagccctaccttcaacagagtcacatgaggggttagggttcctacatatgaattggcagggtggaggtgggaggtggccggggrtgagacacaattgatttcatagcgtcgagttataagatgggtcacagtattagatgggaccagagcagagagggtctgtaggccatggcaagagtgagaatttactcaatacacagtggaagttggggatgagtgagaagcacaagagtggcacactgatttctacaacagtcagtctagctgctgggtggagaaggggagaaggaggaatagtggaaaaagcagggagaccgcttaggaagctgctgggaccgtgcatatgagagatgttggtggcttgaaccagtgctgggtttctca

SEQ ID NO: 421 - DNA, 601 bp, Human
gttataagatgggtcacagtattagatgggaccagagcagagagggtctgtaggccatggcaagagtgagaatttactcaatacacagtggaagttggggatgagtgagaagcacaagagtggcacactgatttctacaacagtcagtctagctgctgggtggagaaggggagaaggaggaatagtggaaaaagcagggagaccgcttaggaagctgctgggaccgtgcatatgagagatgttggtggcttgaaccagtgctgggtttctcagcattggcagtattgacgttttgggtgarataattagttggggagtggcagggcggggggtaggggtgcagtcctgaaccagtgccaggtttctcagcattggcactgttggcattttgggtgagataattagttgtggggggctgtcctgtgtattgcaaaatgttcagcagcttcactagtctctacctgctagatgccagaagcccacccaccccgccccctagtcatgacaatcaaaaatgtatctagacattgacagatgttaacctgggattagggggtggggagaccaaaattgtaccctgttgagaaccactggaccagag

SEQ ID NO: 422 - DNA, 601 bp, Human
ggatgagtgagaagcacaagagtggcacactgatttctacaacagtcagtctagctgctgggtggagaaggggagaaggaggaatagtggaaaaagcagggagaccgcttaggaagctgctgggaccgtgcatatgagagatgttggtggcttgaaccagtgctgggtttctcagcattggcagtattgacgttttgggtgaaataattagttggggagtggcagggcggggggtaggggtgcagtcctgaaccagtgccaggtttctcagcattggcactgttggcattttgggtgagawaattagttgtggggggctgtcctgtgtattgcaaaatgttcagcagcttcactagtctctacctgctagatgccagaagcccacccaccccgccccctagtcatgacaatcaaaaatgtatctagacattgacagatgttaacctgggattagggggtggggagaccaaaattgtaccctgttgagaaccactggaccagagtcatagcaatttgcagtggatagatttaggaatatttgaagacttgtaaaatatagcctgaagggaatggagactgggagagtgaaagatacctctga

SEQ ID NO: 423 - DNA, 601 bp, Human
aaaagagccaggactagatttcattctaatgcttataaggagagttctaggaaaccctcagacttggtaaaccaaggcatttggagatactatgaattggtttaaaaggccatttaccacttcttttgtaattggccttttaaaccaactctcacttagctgattaaatgtggtcatttaaactgctagttaacaatcggaagtgcagtggcgcaatctcagctcactgcaacctctgccttccgggttcaagcgattctcctgcctcagcctcctgagtagctgggattacatgcgcacrccaccacacccggctaatttttgtatttttagtagagatggggtttcaccatgttggttaggctggtctcaaactcctgacgtcatgatccacctgcctcggcctcccaaagtgctgggattacaggcatgagccaccgcgcccggcctaagatttcttattgtggtattctgcagtggagaatgggagttggaaagaaatgttttctcccacacctgtcccgctcctgtctactgaaagctgattaatcagtcagatagtgagttcctattggtagtacgcctccaaaatttggaagag

SEQ ID NO: 424 - DNA, 601 bp, Human
aagtccttccaaatagaaaaactttattaatttaaaaataaccgccaattcagacttcgattcaaacaaggcattttaccaagtccggctgaaagagcttcttaccacatctggcatgtagaatggcagaagactatttttgctagattccttgttgctgcagccgtttctgatgtccttttccccttcacacctttcgtgttacacatgtctgagatgacatgatgctaagtaaccaaagtactgctgcgatggaattgctctgatgtttttttccagagtgaaagctgctattactttaaaaaaaaaaaaacttgaggtttggtttctttccccctctatccgggtgttatacaaatatgtaattaagatgtttgggggttcagatgacaaacaaggagtctacttctaagaatgcatttgcaagccaaaagagtggtgaaccacttcagagtgcgggtctgtgggggatgatgtctgctttgcttcgttttgtggaataatttttaacatttctatttagcattcatgatactctaaatagaagcaggagaacactgtggctctcggatccaggagaggcaggccacgagggctcctg

SEQ ID NO: 425 - DNA, 601 bp, Human
tttcgtgttacacatgtctgagatgacatgatgctaagtaaccaaagtactgctgcgatggaattgctctgatgtttttttccagagtgaaagctgctattactttaaaaaaaaaaaaacttgaggtttggtttctttccccctctatccgggtgttatacaaatatgtaattaagatgtttgggggttcagatgacaaacaaggagtctacttctaagaatgcatttgcaagccaaaagagtggtgaaccacttcagagtgcgggtctgtgggggatgatgtctgctttgcttcgttttktggaataatttttaacatttctatttagcattcatgatactctaaatagaagcaggagaacactgtggctctcggatccaggagaggcaggccacgagggctcctgctgtttggggacagtctgtaactctaaatctttttatatgcagcaattatgaccttaaaaatgggtgactctaatactggcattcattgcctaaaaataattttaatgtgcaaatgccagagaccaggtcatctcagaaatggactagaattgaccactgctatgttttggtgaaacctgataaccttgctttt

SEQ ID NO: 426 - DNA, 601 bp, Human
ctcctttgccatgtgttttcatttctgccagacactggcactggggaagcctcccatcgtctcagactcagggtgtgtgaaaaacaaacctgctttctggactctacagtttgtgcactagcctaagccgaaaatcttgaaatctgtcatcagtgactattgtagtccataggaatacccaagactgggtaatttataaagaaaagagggttagcttttttttttccggctcatggttcttcaggctgttcaagcatggttccaacatctgatcatcatctttttttttttttttttagayggagtctcattctgtcacccaggctggagtacagtggcgccatcttggctcactgcaacctcccacttctgggttcaagcaattctcctgcgtcagcctcccaagtagctaggattacaggtgtgcgccaccacacccagctaatttttgtatttttagtaaagatggggttttgccatgttggccaggctgatcttgaactcctgacctcaggtgatccccccaccctggcttcccaaagtgctgggattacaggtgtgaaccaccacgcccggccaggatctgatcattttctaggag

SEQ ID NO: 427 - DNA, 601 bp, Human
tggagacagattaagaccctgtctctttaaaaaaaaaaaaaaaaaaagtttgtaaaatatcacccagttttccctaacgttagcattttacataatctatacaccaattctcacagccaagaaattaacaatgacacaatactgttaaccatggactatttgaatttcaccagttttcccactaatatcctttttcagtcccaacatccttcattgtgtttacttactatatctagtcttctccagtctgtaaaaatgtgtctatctttgcttgtttttcatgaccttgatatttttgaakagtatggacaggttgttgcatagaatgctccaaattggttctaatgtttctcatcattaaactcatttttatacattttggggaagactactacaagattgacattgcatctcagtgcgtcacatctgtgtgatgtcagcatcttaccactgatgatctcttagccttgaacacttgattgaggtggtgcctgccaggtttctccagtgtaaattttctgcttttcgcattgttactgatatcttagggctgatactcacagtatgcagatgtctcgtttctcttttttcatatttcttt

SEQ ID NO: 428 - DNA, 601 bp, Human
cctgccccagggaggagtttgagttggtacatcctgactgggtactctgcctgtggttagcaaatactctgcatgttgagtgctttcaaaatacagaaacaaacaacttgtggaggcattggaaaagtgtgtttgagaaacaagcagcctcaccatgaatgggagtttgtttccctttctcgtctttctggtcatctgctgcacgggcaggaggagctgtgggttgcttttcttccttggaacatggagcaccactctcccctgtgctgatacacttacaaagaagttcacctactccttggaaagttctggaaaaggggcttctacactgttggcctctcgaggagaacggtttttgtttctgtcttcctggaaaagaggtgactgctggcatcatctttctagataaactccttgctatgatgccattagaagcagtgttcttttgtgttttgcttttgtttttccctgtagacaggaataacattttgactagaaacttccctgatgtaataacgaagatggcctccttagaaagttccagaacagaccccttcacctctgtccccagaagcagaagtaggtgatgcactttcttggc

SEQ ID NO: 429 - DNA, 601 bp, Human
tatttcaagttggaacctctaggtttgaaaaatacatgttttgggtgagagtttgattattcttaaagggacatatctttcaaacatatggctgtggaagaggaaacttgtttttgacttgtaaaataccagcagagccttgcagtgatcacaacttatgtgaaatacagaccatcacccacagtttacgtgttcacactaaagtgccagtctctctatgggttttagagctgatttagatacatgcattgctaatacagtcagcccagccaagatagtgccatcctccgcaagcatccamtaaggcatggagtcagcttccgtcattgttagatcagtacttgtttctttcccttgcttatttttcctaacctctctgaacctgctgtgttggaagcttaaggaacatcatcctctgttgggcagaattcttccatggccaccccagcattatgccccacaccatttgacttactcatttgtgaatgccaactcagaatgtattgctttgattcttgattaggatctcaacctctatttattgttaagactatcaccctttgattcccccccatcccattgtgtccttctaaaggcacag

SEQ ID NO: 430 - DNA, 601 bp, Human
ctgttttcccttctctctcaccgtggccattacgggctgctgtttacaaaaatcctgcaggcctttgacaccccgtcctcccttcccccggcatccctgcccttattctggctttcttctcttccatctcctggtgagcacagcatactgttctcaggcttgttttccttttattgctctccatgtgggacaggtcatgctttatcaacatgtaccattttctacaaatgccgcccttcctctttaaattgcttggatgggcagatcgattttgattagcaacactgcagcagaaacaagktgcatctctggaaggactgggtggttttctcgttattgttgctggtttgggtcacatcggatgctattttaaattctgtgttttattccacgatgggtcttgaatcctttccctattcctaggtttgaaatatgtttcctccctttaaaaaaaagaaggggggcagtattgtgttgaaccaaatgtttttctaccttctcctgtgatctgaatcaggtttcccatttccagcagtacaatgtggttgtattcagtgtgataggggcgtagtggacatgaattatttgcgacagggctgcc

SEQ ID NO: 431 - DNA, 601 bp, Human
cgagtaccctggcctggctttgggttctacacggtctgactttagcctgccttggtctttgttcccctctcactccctccacccctgccccccccaacacatgtggagtaccttaccctgccttcctagttctggaatggctgcccctgtgccaggccaccccattttctagaaccaccttcatacagcccctgcgcatcccactgtactatttccttgtttgtttttcctgtcaatcttgccttccgcgctaatgggacactgatgctgtatggtgatgtgttctcccacagtcatcttytcctcctgtggttggggtggggagctttctctgtgtccccccatgagagtgaggacagtctcatttaatggcaccatggtctgtggagccaggcaggcctgtgtgtctgactccacttcagcgctctcagccagcgtgggcacctcggacccagacagacgccccgagcctgtctttctggagaaggaagtagtaataccttttccttgagggagttatgaggattaactgtgcctggccctgaattcgtgccttgcaggtacttaggaagtgagttattacaagcagtgctttttatca

SEQ ID NO: 432 - DNA, 601 bp, Human
gctttctctgtgtccccccatgagagtgaggacagtctcatttaatggcaccatggtctgtggagccaggcaggcctgtgtgtctgactccacttcagcgctctcagccagcgtgggcacctcggacccagacagacgccccgagcctgtctttctggagaaggaagtagtaataccttttccttgagggagttatgaggattaactgtgcctggccctgaattcgtgccttgcaggtacttaggaagtgagttattacaagcagtgctttttatcatccatagatggagatgttatctaygctataggactgcagaaagaattacagagaattatgtagaatcactagggacttgattaatatttgtttacctttcccccacatggattgatgtcctttattatacttttgtacccccgcttggcaagcccttgacaaatattgatccaacaaaaaattagctctttaatgtatacgtttagaacctgttgctttgtcagtagtggtttttatgaaaatgaatgcttataggtcagacttctggaaaccctaatctgagggaattgggccaaataggaaagtgagccccttaaaggcagt

SEQ ID NO: 433 - DNA, 601 bp, Human
cagttactagagcagagtggccgtagaggctgcaacacggtggccaaagcatgaagctgctgtatagtggcaaggtcacagtgatttccccgcagcctcggtttagagggagacggggtgtgctgagctgtgcctgcttctgtagaaggggccttctccaagtctgagtagccttaagccattaggactgctgagtctttctccacaaaaatatgtgggaggcctgcagggcaggtgctcaactaagctctggggctgcaaagatccagagccatgcccctccttggaggcaggtccttgyagacgaggacaatcgtagccttcctgattaaagcaggaattgtccaatcaggctatatgacgggcatcgtccatagtcttcaccaggggagcttttctgactatacatctctagccctgtggcttgagccagtcacttaatttcccctgagctttggtttcctcctcctggtagcagagagactatcagagtgaggggcagatgcaatagcatatgtaaaacacttagcgttgggcctggtgtttaactgcaataaatgttagctcatattttactgtgacatagatgctgtatgccttt

SEQ ID NO: 434 - DNA, 601 bp, Human
ttttagtagagacggggtttcgccatgttggccaggctggagtttcttgaagtattgactgatccttgactctgaactgtatgatcaaagacttttgaaatggcacaccgtttcttaacatttaggccaatttcagttgctcatatccaaaaataagtcatgattttcggagtcagtgcgcagcacttagtacaacaatccaaacccttgtacagaccatcctagtagaaatgtggatcttgagtatctcagcttcttagtagattttgaactccgtgaaagcaggagccaggcctctcamagcaagtctctccaatatgctcagtaaatatttgtcagatcgagcaatgaccagatgatgaaatacattaaagccttagggagaactgagactactgcaccagtttttgtgcactatcatgctggaaatctttccaacatgtattctgtacttctttgcttcttactccagtgaatataatttagtcatttctggccaacttgaggacatcagcgagcataaattgttgtattatgcataatacagtgataccctcaaggctgagtgggaggcagtttgccctctgctgaaggtttcttg

SEQ ID NO: 435 - DNA, 601 bp, Human
ttggtacaaggcacggaccaaatccatggtacgctcactcctttcctttcagtaatactgcctaaatagggcacatgtacctaaaaggattttgtacattccttgacagcagaattctcatcttctgttgcatatcccataatgctgggaacacaaaataaaaatggtagcttttcacattcacttttggcctcaattttttgttattccccaatgaggatcatttcatttggggctggtctccggaaaaaagtagatcaagcttttcagatgagatttgggtgaaaccctgacaaactcttttttattgccttccctaccacatagtggtggatcaggaaactgtagggcttatgatgctgggaaatttctgctaatgcaataaagatttttgctgttgaaagaatttgatctgttttatgtataacatgcagagagcagaagcatatattatctgtagcagatgatagagcagggtatatgggcaagttagaaaaacacagttctcactacatttgaagaaaaaggacaaggagttgtcacaaggatccaggagagtcgcacataattttctgtcgtgcattttgttgactgttcctct

SEQ ID NO: 436 - DNA, 601 bp, Human
acagatgttaacatcttacataaccgtaatacggttatcaaaacagtgttcactccatactccagtgctgttaatctccagactgaattcggatttcactattttcccactgatgtccctttttttggttccagatccaagagacgatcctacctggcatttattgtgttcagtttttctaattctgggacgttttcctgggttttctttagtcattcacgaagttcgcacttttggagaacatggggccagttattttgtagaatatctttctgttagagtttgtggatgtttcctcctkattaaatttggggggtacatttttaacttggagatcacagaggtgctgctgtttgtgtctttgcgcatcctgtcaggagatgcgtgatgtttcctttcctggtgctgttagctttgatcccttagttaaggtggtctctgtggcttcctccattatcattactatttttctctttgtaattaggaagaatcttttggaggtagatacttgagactatctaaacaagcattctgttcctcattattctttcacccactaattttaacatccattactgtgatgtttgccaaatggtgattt

SEQ ID NO: 437 - DNA, 601 bp, Human
tactatttttctctttgtaattaggaagaatcttttggaggtagatacttgagactatctaaacaagcattctgttcctcattattctttcacccactaattttaacatccattactgtgatgtttgccaaatggtgattttctatttctgttttctacacttagtaattggattctactctcaggattttatgtattttttaacagtgagggacataaactttttaactagcagtggcaagtccacttttatttgggaggacaattactagtcacatgaagaagaaaaaatatgcagaascttaagaaatcccacatatgaatgttatttgaaatgttcttgccctttctccctacaaaggaggtgaagaagatgacaggagatgttaattgccaaaatagtctcatagttttggtcctggctgcaaatctctcgtttttgatactcaagagaatgctattggggaactgactctgaagcacagcccagatgcttgagatgggttgggaaggtttacatcaacaccatgaatttaatttatcatgtgacattttatttctgagtttttaaagctgtaattaaaagaagtgttcaaagtgt

SEQ ID NO: 438 - DNA, 601 bp, Human
cggcgtgcatagcggccacgtgactgcgccccggccacgcccaccgtccctcacgtggtcccaggccacgctgggcttcggcatgtgctaaagtggatagaaaagggagtggggcccgggcgtggctttgtggtttgggaagatatgaactccttggggtttttttctcttttaattctttaattttgatatttggaaatgcgtaaaaggtttttcatttgtccttgaccacgtggtccaaacctcaatttccctagcagaacgcggtttcgatcactggtggatccgtctcacagcaccrgtcatgctgcctcgctgggaagtggagggctcaggattcccgtggttcacgatccattttatgttggaaggaaatcattttgaactatctcagtacacaccctagtgtatctttaaacctaattgagtgttgatggaaaatctgcggtccgagaaccgtaagaaaagggggctcccacctcccgctctggggtcgccacttgcctcgcaggcaggaggaggctcccagagtagatacaacttgcccgtcacccggatgggttggtagtgcacatatgcacggggcgcagtttaaaatgaa

SEQ ID NO: 439 - DNA, 601 bp, Human
ctagcagaacgcggtttcgatcactggtggatccgtctcacagcaccagtcatgctgcctcgctgggaagtggagggctcaggattcccgtggttcacgatccattttatgttggaaggaaatcattttgaactatctcagtacacaccctagtgtatctttaaacctaattgagtgttgatggaaaatctgcggtccgagaaccgtaagaaaagggggctcccacctcccgctctggggtcgccacttgcctcgcaggcaggaggaggctcccagagtagatacaacttgcccgtcaccyggatgggttggtagtgcacatatgcacggggcgcagtttaaaatgaaagtaaaagatgcaaatgtgtttgcaaaagaaaaattaacataggatacgtgcgggcgttctcagttgaactcggtcttactgttccacgcgagcaccccatgactcagagcccaaatctcagcggaacagcccaggacgctcctgccgtccacaggaagacgcctctgtctctgtcccccgccgccaccacacagatgcacgtactctcttcacttccgtgtacccagtaaatgcagatcctgatttaaatct

SEQ ID NO: 440 - DNA, 601 bp, Human
actggcaccaggatgactttttgtgaagcagagcagttggtcttagatagtggaggtgcgggaggcatgagaactgggcagtctgacggctgcaccagccagttggctgtcctttccacctccatgcccaggagctggcccagggcgcgcatgcacaaagccagtgctcttttcaatcagaaaacagcctgcgtatgttcttgcttgcaactcagatatccagcccactgatccaggaagagattcctttgacctgggaagtcataatggcagatatttagacccagctctcaagcaagcmtccaagttgttccggtgaacccgtaactttgagtaacctctgattgaaccagagagtaggaactaggtgcagaaccttgttgaatagaattgtttagcatcgtccatttgttagagcatttcaggatgcctgtcctaaaatttggtatcataatggtatttacctctcactcacctccatctcagcccagtaattaataacaagggacttgcttcttcacctgtttctttattggttgtaggaagtcttttccttaccacagaggaaggagcttctggatccctttgctacgtccagaga

SEQ ID NO: 441 - DNA, 601 bp, Human
gtgaagcagagcagttggtcttagatagtggaggtgcgggaggcatgagaactgggcagtctgacggctgcaccagccagttggctgtcctttccacctccatgcccaggagctggcccagggcgcgcatgcacaaagccagtgctcttttcaatcagaaaacagcctgcgtatgttcttgcttgcaactcagatatccagcccactgatccaggaagagattcctttgacctgggaagtcataatggcagatatttagacccagctctcaagcaagcctccaagttgttccggtgaaccygtaactttgagtaacctctgattgaaccagagagtaggaactaggtgcagaaccttgttgaatagaattgtttagcatcgtccatttgttagagcatttcaggatgcctgtcctaaaatttggtatcataatggtatttacctctcactcacctccatctcagcccagtaattaataacaagggacttgcttcttcacctgtttctttattggttgtaggaagtcttttccttaccacagaggaaggagcttctggatccctttgctacgtccagagagttttcatctaatctgggtgta

SEQ ID NO: 442 - DNA, 601 bp, Human
acacatcctcagggatgttgcacaccagtttgcagcctgcagcttctgccctctggcctgcccaggtcctcggctccgggacgaggatgctccgggatttcgggagacagcagttgttttgacatgaatctcaaagttcctacaaagcttatttctttgaagaaggccaaaaaaaaaatgaaacattttcagatctttgttttcagattattcaagtccagaatgttggataagatttttgaagaagagatttatgcttgagattccttttagtttctttctttcttttcttttcttttcctttttttttttttttaggtgacttggccagtttgggtttttacggtgttcagggaaagggttaagaagttaatttgggaagtacagtcatgtgttgtacaagttgctgtctactgatcccttcattgagcaagtaaacttcacacattctcgtgtctgcaaagcatgtggatgcatgggcagttatgtgtatgaactttttttttttttgagaatggctttagtgttcagaccaaggatggaatgaaagatcacgtgtgctttccactgtagagctgccctgcttgttttgattttatag

SEQ ID NO: 443 - DNA, 601 bp, Human
cacatcctcagggatgttgcacaccagtttgcagcctgcagcttctgccctctggcctgcccaggtcctcggctccgggacgaggatgctccgggatttcgggagacagcagttgttttgacatgaatctcaaagttcctacaaagcttatttctttgaagaaggccaaaaaaaaaatgaaacattttcagatctttgttttcagattattcaagtccagaatgttggataagatttttgaagaagagatttatgcttgagattccttttagtttctttctttcttttcttttcttttctcttttttttttttttaggtgacttggccagtttgggtttttacggtgttcagggaaagggttaagaagttaatttgggaagtacagtcatgtgttgtacaagttgctgtctactgatcccttcattgagcaagtaaacttcacacattctcgtgtctgcaaagcatgtggatgcatgggcagttatgtgtatgaactttttttttttttgagaatggctttagtgttcagaccaaggatggaatgaaagatcacgtgtgctttccactgtagagctgccctgcttgttttgattttatagt

SEQ ID NO: 444 - DNA, 601 bp, Human
gttgccaatatgattggatttgtactgccaagatggggttttagcacttctaatgcattctggcaaggctggtatacttgtatcaagtgcacagccccactaccaccacctctaccacccacaaaaataaaaactagcaaaataaaatatgagccaacagaattctgtgggaatggcaagtgttttgtttttgtttttagtagtaatctttgcgagaacattccaaagatgatagttttacatttgtatgtttttttccgaggcacttttgaatcatcagatagattaaatataagttccrtgtatttttgaaggtgggagtgttctttggtacagttcccccaaaaaactggttctcatgaggcttatgtggtaattctgttaacgagaatgtatgattatctgggatactctgttctgctctccatcctggataagagtttactttgaaagtctagttgatcttttgtgatttctgcacaatgtaaaaggtactttaacttcaggagatagggccagcaatcagatttgatgatggaaaagagtagtgtagcatttaagcataatgtatactctataataaatgtttacaagtccaaaa

SEQ ID NO: 445 - DNA, 601 bp, Human
cttacacataaaggcattttatcacaaagccatctaaaacaaaagtgttaaaggcacaatgctgtgtttaaaaagcatgtacttctttaagagctcaaatttaaatatataatacaaacttaagatccaaggaagaaaatggacccaggacacgaagagaagttaacgccacaggtaatgcagatggccaagagatgtgtgaaaaagataatccagcctcaccaacagccacagaattgaaatgagatacctgtttctgcttctggcattgggaaagaaagaaaaatggcactagcagccttttttttttttttttttttttttccccaaaaaatttgctactcttgaggttctgtcaaagaatgtgctgtggcctctagaagcatttttaaaaagagactttcacaagtgattgtgcaaaattgtgaggtcactgaataggtgtgtatcctcctaaggaggtagcgttggaggagctgttcttgttcaatttactcagcacctgtgaagaggcttcactgtgatttgcctgtacaggtgtgcaggtaaaaatctaagttccacaggtagtgcaaaaaaatctacctccctaggtacctcg

SEQ ID NO: 446 - DNA, 601 bp, Human
gtgtgcccaccaccacacctagctaatttttgtatttttagtagagatcggctttcaccatgttgaccaggctggtcttgaactcttgacctcaggtgatccacccgtctcggccttccaaagtgctgggattacaggcgtgagccactgtgcctggccggcccttccttttagacaatagaaacatgctgcaaccacataccaccataaacacggtgggggaagaggctgcaatcaacagtcaggaggatctgggttccaagcccaggtttgcagtgtaacagctgtgtgctcttggtgygaacatttggtcatgtacaaatgaggataatgatactgcccccttgtgatcattagggggattaaattaaatgcagaaatatatgtgagatgcttaatgtgttgtaaggcgcatggaatatatttagtgaatattaactgtatattaatacaaagtcctgtattcagaatctccagtataaattacatttatatagtagagatatgaatagtttttgtgaacaagaagacctggaacttcaggtgactagaagctcagagtgagccagctatgtttgatgatagttattcttaagatcac

SEQ ID NO: 447 - DNA, 601 bp, Human
cactttcgtgaagttaggagcggttaatcctcctgcacgaggatgcatgcctgctagggaaagcctccctgcgtttatatggaacagtggtgtgtaccttagggcaacccagaaacagctgagatggccctaaactcttccgtattttgattcagaagctttaccttatttgaacatctgcagaataagttctttcctttagaaatgattggggataaaattgtttgcattatgaaatattgtatggccaggtggcccctctttcatgttttgttccttgtgaagaggttgagtctcctattttttttttttttttggagatagagttttgttcttgtccctcaggctggagtaaaatggtgcaatcttggctcactgcaacctccgcctcctgggttcaaacgattctcctgcctcagcctcccaagtagctgggatcacaggcacgtgccaccacacctggctaatttttgtatttttagtaagagatggggtttcgccatgttgggcaggctggtcttgaactcctgacctcagttgatctgcccgcctcggcctcccaaagtgctgggatcacaggcgtgagccaccacgcccagcc

SEQ ID NO: 448 - DNA, 601 bp, Human
taaaagctgaaatgcctttaatcgcactcagtgtgtttattcatggaagccagagaagagggtcccttcctttcccccatagcgccgtaattggaaatttggtagtactaggtgaaattctcagttttggcgctcgcatggaacagccatccatctgctggcgagacacactgcccggggcttttcaagaaatcccttaatggtcctgaacactaataatatttatatacattgagatgagacaaaatttacagcgggctctggggctggctccaggactctctaatcccacacttgctcrcgttctcttgcttgcctcctagaatcctttcaggttgtgcttcagtgaggggagcatggtgtccgtctctgcagcaatgcttatttatgcagttcgtcctctaacaaacagagcaactttccttttgaccttcccctcttctccccatcacattccattgctgcccccgcatagagcatgtgcttatgcatagtttgcatcatttaacacgaaggaaccccttgatttgtgatccctttaagaagttgctctgtatataaagaaaatgatttttcctggttggttttactgaagttcctt

SEQ ID NO: 449 - DNA, 601 bp, Human
ttcaacgttcttattactactgcattaatagctacttgatcttaatgtctattacacatcattttatataatgttttctttaaattgtcagggaaagggattctgcaagtagatgttggtccccccagttagtgtctgatgatgatggtaagattctcagagtttccttcctctaatgacaaagcatggtgatggtgatgtctgaagagcagcctcggtgctccaagatgggtgtatgcttaatactgctggcacacgcctgacgagcgggaatgtgagcgttgtttctgtaaccagtttyactgaacctcacagatccattatacgacgtgaattttgtgggaataacataggctgggagtctgctctcttccagcctggtccctctcttctttcagccctaccctctctgatcatcatgtcccttgcactgcggccaggtaacctttctgatacgaaggtctgggcatgttgttcccttgcctaaaactttccatggtttcgtattatccacagttgggctaaaccctctgggacaggccttcagtgcctccccgggcagtggtccctggccttcttcagtaacacccaagcccttgca

SEQ ID NO: 450 - DNA, 601 bp, Human
aagcccaggaaacaccaggcagctccactcactcccgtacttgctgtgtcgtccgttccctggggacaggattgtcgctgatcctgcgtgcatctgtctggcacacaggtgcagcacacattaaatagctgctaaatgaataaatgaagaatagatggaattatattctgttgtgaccagtttaaaaacatgaaattggaatacccaattgcagtgtttctttagatcttggaccttgaggtgacctctgtaatggatatatttgaaattattaactgtcttcaagtgggggtttgatgaaagagagagagagagtgtgtgtgtgtgtgtgtgtgtgtgtgtgtgtttacagaaaatatgctaggtttgtacattcaaatttgtgttatcctcttcaagaaagtcaccttggtagacagcatatatatcccaacattttaggaactcataaaatgcatacttttttggtgtgatcagagatgggtaactccttattacttgtgggttagattagtttttggaaatagcctggagtcattgagagccaatccttatcaacaaaatggcataaatggacaggaatgggtttcttcttcacttt

SEQ ID NO: 451 - DNA, 601 bp, Human
cagagtcaaaaagatacacatttaaataattttgtattgttttccaatttgaggataaagtaggaaatgtataatgcaaaccagatttcatattttgttgatttagacttaatttacaagtaaggctgacagcccacagagtgtgatcacgacagcattgttatggaaataaatgccagctcatgcatttgggatgtacaccatggatctgtggttattagatactgatttcactttagcacacgaagaggcttagcggaggtggcttctaatatcctatggttctgtgggctcggagatrctactcacccacttgtcagaggcattgaaaccagagcaactgcatcttgaataggagctaggtaaaatgaggccgaattcccagacagttaagacattctgagtcacaggatgaggttaaaggtcagcacaaaatacaggtcataaagaccttgctgatctagcagatgcagttaaagaagccggcgcaaacccaccaaaaccaagatggtaacgagagtgacctgtgatcgtcctcactgctgcactcccaccagcgccatgagtgtttacatgtcatagcaacatcaggaagttaccc

SEQ ID NO: 452 - DNA, 601 bp, Human
gcacaaaatacaggtcataaagaccttgctgatctagcagatgcagttaaagaagccggcgcaaacccaccaaaaccaagatggtaacgagagtgacctgtgatcgtcctcactgctgcactcccaccagcgccatgagtgtttacatgtcatagcaacatcaggaagttaccctatatggtctaaaatggagaggtatgaataatccaccccttgtttagcgtgtcataaaaatgggcaaccagcagccttccaggctgctctgtgtatggagtagccattcttctgttcctttactttyctaatcagcttgctttcagtttacagactcaccctgaattattcttgcgtaagatctaagaaccctctcttggggtctggatcaggactcctttcctgtaacacacctatgttcttggacttaagaatgaccctcagacatggtgacttctttgtcatctaacagctttggcttatttgaggtaaaacctttgatatctaaggcagcagaaatttccctgaagtcattttgaatggtatcatctttactatagtgtagtttaatcattttcaaagtaagcatttctgcacactaaggctt

SEQ ID NO: 453 - DNA, 601 bp, Human; identical to SEQ ID NO: 179

SEQ ID NO: 454 - DNA, 601 bp, Human; identical to SEQ ID NO: 180

SEQ ID NO: 455 - DNA, 601 bp, Human; identical to SEQ ID NO: 181

SEQ ID NO: 456 - DNA, 601 bp, Human; identical to SEQ ID NO: 182

SEQ ID NO: 457 - DNA, 601 bp, Human; identical to SEQ ID NO: 183

SEQ ID NO: 458 - DNA, 601 bp, Human; identical to SEQ ID NO: 184

SEQ ID NO: 459 - DNA, 601 bp, Human; identical to SEQ ID NO: 185

SEQ ID NO: 460 - DNA, 601 bp, Human; identical to SEQ ID NO: 186

SEQ ID NO: 461 - DNA, 601 bp, Human; identical to SEQ ID NO: 187

SEQ ID NO: 462 - DNA, 601 bp, Human; identical to SEQ ID NO: 188

SEQ ID NO: 463 - DNA, 601 bp, Human; identical to SEQ ID NO: 189

SEQ ID NO: 464 - DNA, 601 bp, Human; identical to SEQ ID NO: 190

SEQ ID NO: 465 - DNA, 601 bp, Human; identical to SEQ ID NO: 191

SEQ ID NO: 466 - DNA, 601 bp, Human; identical to SEQ ID NO: 192

SEQ ID NO: 467 - DNA, 601 bp, Human; identical to SEQ ID NO: 193

SEQ ID NO: 468 - DNA, 601 bp, Human; identical to SEQ ID NO: 194

SEQ ID NO: 469 - DNA, 601 bp, Human; identical to SEQ ID NO: 195

SEQ ID NO: 470 - DNA, 601 bp, Human; identical to SEQ ID NO: 196

SEQ ID NO: 471 - DNA, 601 bp, Human; identical to SEQ ID NO: 197

SEQ ID NO: 472 - DNA, 601 bp, Human; identical to SEQ ID NO: 198

SEQ ID NO: 473 - DNA, 601 bp, Human; identical to SEQ ID NO: 199

SEQ ID NO: 474 - DNA, 601 bp, Human; identical to SEQ ID NO: 200

SEQ ID NO: 475 - DNA, 601 bp, Human; identical to SEQ ID NO: 201

SEQ ID NO: 476 - DNA, 601 bp, Human; identical to SEQ ID NO: 202

SEQ ID NO: 477 - DNA, 601 bp, Human; identical to SEQ ID NO: 203

SEQ ID NO: 478 - DNA, 601 bp, Human; identical to SEQ ID NO: 204

SEQ ID NO: 479 - DNA, 601 bp, Human; identical to SEQ ID NO: 205

SEQ ID NO: 480 - DNA, 601 bp, Human; identical to SEQ ID NO: 206

SEQ ID NO: 481 - DNA, 601 bp, Human; identical to SEQ ID NO: 207

SEQ ID NO: 482 - DNA, 601 bp, Human; identical to SEQ ID NO: 208

SEQ ID NO: 483 - DNA, 601 bp, Human; identical to SEQ ID NO: 209

SEQ ID NO: 484 - DNA, 601 bp, Human; identical to SEQ ID NO: 210

SEQ ID NO: 485 - DNA, 601 bp, Human; identical to SEQ ID NO: 211

SEQ ID NO: 486 - DNA, 601 bp, Human; identical to SEQ ID NO: 212

SEQ ID NO: 487 - DNA, 601 bp, Human; identical to SEQ ID NO: 213

SEQ ID NO: 488 - DNA, 601 bp, Human; identical to SEQ ID NO: 214

SEQ ID NO: 489 - DNA, 601 bp, Human; identical to SEQ ID NO: 215

SEQ ID NO: 490 - DNA, 601 bp, Human; identical to SEQ ID NO: 216

SEQ ID NO: 491 - DNA, 601 bp, Human; identical to SEQ ID NO: 217

SEQ ID NO: 492 - DNA, 601 bp, Human; identical to SEQ ID NO: 218

SEQ ID NO: 493 - DNA, 601 bp, Human; identical to SEQ ID NO: 219

SEQ ID NO: 494 - DNA, 601 bp, Human; identical to SEQ ID NO: 220

SEQ ID NO: 495 - DNA, 601 bp, Human; identical to SEQ ID NO: 221

SEQ ID NO: 496 - DNA, 601 bp, Human; identical to SEQ ID NO: 222

SEQ ID NO: 497 - DNA, 601 bp, Human; identical to SEQ ID NO: 223

SEQ ID NO: 498 - DNA, 601 bp, Human; identical to SEQ ID NO: 224

SEQ ID NO: 499 - DNA, 601 bp, Human; identical to SEQ ID NO: 225

SEQ ID NO: 500 - DNA, 601 bp, Human; identical to SEQ ID NO: 226

SEQ ID NO: 501 - DNA, 601 bp, Human; identical to SEQ ID NO: 227

SEQ ID NO: 502 - DNA, 601 bp, Human; identical to SEQ ID NO: 228

SEQ ID NO: 503 - DNA, 601 bp, Human; identical to SEQ ID NO: 229

SEQ ID NO: 504 - DNA, 601 bp, Human; identical to SEQ ID NO: 230

SEQ ID NO: 505 - DNA, 601 bp, Human; identical to SEQ ID NO: 231

SEQ ID NO: 506 - DNA, 601 bp, Human; identical to SEQ ID NO: 232

SEQ ID NO: 507 - DNA, 601 bp, Human; identical to SEQ ID NO: 233

SEQ ID NO: 508 - DNA, 601 bp, Human; identical to SEQ ID NO: 234

SEQ ID NO: 509 - DNA, 601 bp, Human; identical to SEQ ID NO: 235

SEQ ID NO: 510 - DNA, 601 bp, Human; identical to SEQ ID NO: 236

SEQ ID NO: 511 - DNA, 601 bp, Human; identical to SEQ ID NO: 237

SEQ ID NO: 512 - DNA, 601 bp, Human; identical to SEQ ID NO: 238

SEQ ID NO: 513 - DNA, 601 bp, Human; identical to SEQ ID NO: 239

SEQ ID NO: 514 - DNA, 601 bp, Human; identical to SEQ ID NO: 240

SEQ ID NO: 515 - DNA, 601 bp, Human; identical to SEQ ID NO: 241

SEQ ID NO: 516 - DNA, 601 bp, Human; identical to SEQ ID NO: 242

SEQ ID NO: 517 - DNA, 601 bp, Human; identical to SEQ ID NO: 243

SEQ ID NO: 518 - DNA, 601 bp, Human; identical to SEQ ID NO: 244

SEQ ID NO: 519 - DNA, 601 bp, Human; identical to SEQ ID NO: 245

SEQ ID NO: 520 - DNA, 601 bp, Human; identical to SEQ ID NO: 246

SEQ ID NO: 521 - DNA, 601 bp, Human; identical to SEQ ID NO: 247

SEQ ID NO: 522 - DNA, 601 bp, Human; identical to SEQ ID NO: 248

SEQ ID NO: 523 - DNA, 601 bp, Human; identical to SEQ ID NO: 249

SEQ ID NO: 524 - DNA, 601 bp, Human; identical to SEQ ID NO: 250

SEQ ID NO: 525 - DNA, 601 bp, Human; identical to SEQ ID NO: 251

SEQ ID NO: 526 - DNA, 601 bp, Human; identical to SEQ ID NO: 252

SEQ ID NO: 527 - DNA, 601 bp, Human; identical to SEQ ID NO: 253

SEQ ID NO: 528 - DNA, 601 bp, Human; identical to SEQ ID NO: 254

SEQ ID NO: 529 - DNA, 601 bp, Human; identical to SEQ ID NO: 255

SEQ ID NO: 530 - DNA, 601 bp, Human; identical to SEQ ID NO: 256

SEQ ID NO: 531 - DNA, 601 bp, Human; identical to SEQ ID NO: 257

SEQ ID NO: 532 - DNA, 601 bp, Human; identical to SEQ ID NO: 258

SEQ ID NO: 533 - DNA, 601 bp, Human; identical to SEQ ID NO: 259

SEQ ID NO: 534 - DNA, 601 bp, Human; identical to SEQ ID NO: 260

SEQ ID NO: 535 - DNA, 601 bp, Human; identical to SEQ ID NO: 261

SEQ ID NO: 536 - DNA, 601 bp, Human; identical to SEQ ID NO: 262

SEQ ID NO: 537 - DNA, 601 bp, Human; identical to SEQ ID NO: 263

SEQ ID NO: 538 - DNA, 601 bp, Human; identical to SEQ ID NO: 264

SEQ ID NO: 539 - DNA, 601 bp, Human; identical to SEQ ID NO: 265

SEQ ID NO: 540 - DNA, 601 bp, Human; identical to SEQ ID NO: 266

SEQ ID NO: 541 - DNA, 601 bp, Human
tggacttactagatcacatggtaagcttttagtttagctttttaaggaactgctaaaactgtttttccatgggagcagtgtacaagtgttccagttctccatatgctcaccaaaacttaatttccttttttaaaaattatagctatcctagtaggtggtgggaagtggtatcttactgtggttttattttgtatttctttaatgactaatgatgttgagcatcttttaatgtgcttattggccattatatgtcttctttgggaactgtctattaagtcctttgcccattttttaattgagtttttttttctgttgaattgtgggagatctttatatattctgaatattaaacccttattgggtgtatgatttgcaaataatttctcccattttgtgggttttcttcactttttgatattgttctttgattcacttttaaatttttatagagtccagtttatctgttttttcttttattacctatgcttttggcatcatacctaattcccaaatccaatgccatgaagattttctgttatgttttcttttaatagttttatagttttactttttctattggagttttaagtaaattcttgta

SEQ ID NO: 542 - DNA, 601 bp, Human
tttctttaatgactaatgatgttgagcatcttttaatgtgcttattggccattatatgtcttctttgggaactgtctattaagtcctttgcccattttttaattgagtttttttttctgttgaattgtgggagatctttatatattctgaatattaaacccttattgggtgtatgatttgcaaataatttctcccattttgtgggttttcttcactttttgatattgttctttgattcacttttaaatttttatagagtccagtttatctgttttttcttttattacctatgcttttggcrtcatacctaattcccaaatccaatgccatgaagattttctgttatgttttcttttaatagttttatagttttactttttctattggagttttaagtaaattcttgtatattagtgtgatacattttaagttatttttgtatatggtgtgaggtaggggtccaacttcactcttttccatatggagatccagttgtcccagcaccacatgtttaagagtctattctttccccactgaatggacttggcacccttgtcaaaaatcaattggtggtaaatgtatggatttactcctggaatct

SEQ ID NO: 543 - DNA, 601 bp, Human
agcatcttttaatgtgcttattggccattatatgtcttctttgggaactgtctattaagtcctttgcccattttttaattgagtttttttttctgttgaattgtgggagatctttatatattctgaatattaaacccttattgggtgtatgatttgcaaataatttctcccattttgtgggttttcttcactttttgatattgttctttgattcacttttaaatttttatagagtccagtttatctgttttttcttttattacctatgcttttggcatcatacctaattcccaaatccaakgccatgaagattttctgttatgttttcttttaatagttttatagttttactttttctattggagttttaagtaaattcttgtatattagtgtgatacattttaagttatttttgtatatggtgtgaggtaggggtccaacttcactcttttccatatggagatccagttgtcccagcaccacatgtttaagagtctattctttccccactgaatggacttggcacccttgtcaaaaatcaattggtggtaaatgtatggatttactcctggaatctcaattctattctattgtatttata

SEQ ID NO: 544 - DNA, 601 bp, Human
tcttttaatagttttatagttttactttttctattggagttttaagtaaattcttgtatattagtgtgatacattttaagttatttttgtatatggtgtgaggtaggggtccaacttcactcttttccatatggagatccagttgtcccagcaccacatgtttaagagtctattctttccccactgaatggacttggcacccttgtcaaaaatcaattggtggtaaatgtatggatttactcctggaatctcaattctattctattgtatttatatttctgtccttatgcctgtaccacamtgttttgattacagtagctttgtagtaagtttagaaattgggaaacatgagtcctccaactttgttcttcttttcaagattattttggctatttggggtcccttgcaattctgatgagtttgaggatcaccttttccatttctgcagaaaagccttttgatagggattgcattgaatctgtagataactttgggtagtattgacatcttaacaatattaagtctttctatgcataaacatgggatatctttccatttatttgtgttttctttaatttctttcagcagcattctgtagttt

SEQ ID NO: 545 - DNA, 601 bp, Human
gggtagtattgacatcttaacaatattaagtctttctatgcataaacatgggatatctttccatttatttgtgttttctttaatttctttcagcagcattctgtagttttcagagtacacgtttttcacctccttggttaaatttattccttggtattttattcttttagctgctattgtaaatgcagttactttcttagtttcctttcagattgttcatttctggtgtataacaacagctgatatttcaacgttgatgttgtactctgaaactttgttgaatttacttattagatctagwagctttctttgagatttttatatgggattatgtcatctgtatatagagatagttttacttcttcctttccattatggatgccttttatttcttttccatgtctaatttctctggctagaactttcaatatgatgttgaaaagcagtggtgaaagtgggtatctttgtcttgcttcctatcttaggtggaaagctttcagtctttcaccattaagtatggtgttagctgtgggttttcataaatgccctttatcatgttgaggaaatacccttttattcctagttttctgagtttttatca

SEQ ID NO: 546 - DNA, 601 bp, Human
cacccagaaacatcctcacagacacacccagaataatggttagccaaatatctgggcaccccatggcccactcaaattgacacataaaattaaccaccacagtagagtatatgggtacaaatataattatgtgatatagatttcagggtaagagcctgtggaaattcatttttgattgcttctagtgaaatcggaagcaagatcatcagctaagagtgacgatcggtggaggagatatgaagtttaagtggagaggagaaggtataaaatagtcttaggaggggaggatagtaaatagatkagggaaaagttgtaggattgccaggaagtagtaagggcccacttgaggctggtggtcacaaatttaaggtgagaccagtcaaaatggttgtgcttttcacctgctgcattcattcagctgcataggtacaggcacagagtaggtcaagagttcttttttattcggggttagagttttgccaggagatagtaataaagccagaagggcaatgaatttgagggagtatgcaaggaagtggctgttaacttggagtttaaactagtcaagaagagaattaaggactgcccaaggggtgaggac

SEQ ID NO: 547 - DNA, 601 bp, Human
gaagtggtcttacattttaattatcccatcctgtcaacaagagtgtcttcagttgcaagtaatggaaaaaccattcaaactgacttcagcaataaaaggttatttattggtctgtttcatggagacatctgaggtagagtggccttcaggcaagttcactcagggatccgactatttttctggccttattcttggccctcttctatgaaaacaccttcagggtggtttcttgtatgcttgtaagatggctacttgcatcaaccatgaccacatctagcaggagcaaaagcatcctttcccrtaccagaggagagtcccgaaatttgttgcaattggactgccttggaagcaataattatggccaggagatggaggctagagaactgagacctgatcatagctcctatccttgaatcagttgtatagcaaggggaattggattttccttaagacagttggatttcacctgtagtcttggtgatgaggtcagttccatccataaaactttgctgttacacattttgggatggggtgaggagggctgaatggagattaggatgctattgaaatttgctgtacacaatggatcattatcgtcttc

SEQ ID NO: 548 - DNA, 601 bp, Human
ctgaggtagagtggccttcaggcaagttcactcagggatccgactatttttctggccttattcttggccctcttctatgaaaacaccttcagggtggtttcttgtatgcttgtaagatggctacttgcatcaaccatgaccacatctagcaggagcaaaagcatcctttcccgtaccagaggagagtcccgaaatttgttgcaattggactgccttggaagcaataattatggccaggagatggaggctagagaactgagacctgatcatagctcctatccttgaatcagttgtatagcarggggaattggattttccttaagacagttggatttcacctgtagtcttggtgatgaggtcagttccatccataaaactttgctgttacacattttgggatggggtgaggagggctgaatggagattaggatgctattgaaatttgctgtacacaatggatcattatcgtcttctttcttagtgttaaggtaatcagcctctttttcctcctcctatgcttgactttactaaaaccatgagacatgtttaacctcaggactccaatttgaaaaaatatagactgttatttactttattactt

SEQ ID NO: 549 - DNA, 601 bp, Human
tgtaatctcagcacattgggaggctgaggtagggaggattgcttgaggccaggagttcaagaccagcctgggcaacatggtgaaactccatttctacaaaaaatacaaaaattagctgggcatggtggcatgtgcctgtagtcccagctacttgggaggctgagtgggaggattgcttaagcctggggaggttgaggctgcagtgagctgtgactgagcaacagagctagactctgtctcaaaaaaaaaaaaaaaagagatgggttttgaaattcagtactttttttgagtgaggtccaatgggtcagaaagaagcattggataaatgaatccattttctcttctctgtttgaatttgtaatttgaaagaatattctacctataaagtacttcagtgcttaattagctgtcagtgaatttatatatcttatctaattcatatggatttgctatttttatctgtacctacagattcctgacctctctaaggggatcccagtatactatagggaatgaggtataatagaagtaaaagacctatcactagtcctgtcatcattccaactcatgtgtaattatagtttaaaagaagtgacatcat

SEQ ID NO: 550 - DNA, 601 bp, Human
tcctgtcatcattccaactcatgtgtaattatagtttaaaagaagtgacatcatgtgtattgctgtttatctttacattaatcttgtggtcaagaaagcaaatactataatatataataattatataatatcataagacaagtaatataataatgggaatataatcccattttacaaatgaggaaatgaaaatttagagaaataaagtgacttgtccagggtcacatggatactaagtgaccaagtgtcaaagcagaattttccaaataacttaaagataattcttgtacaaatatagaaygaacacatgtcatatgtgttgtgttaatgagggaaccagaaggatgacaacattggttcagagagatgcaaagataaatatagacattggaggaaaaagttggaaataagattgttaggttagatacaaagctgtgttataggccaataaaaaccatagactttgaggttatcttttttactggacaggattcagttacacctttatgagaccaaaatttattatttaacatgtggatattagagtctgagttttaaaattattagtaaatgaccgtcaaataaagatatgtcccctaat

SEQ ID NO: 551 - DNA, 601 bp, Human
atttcatcacattaacctttacatattttgaataaaatagtattgaaccattttaaatagtaagtggaaatttttccacattaaacagtataacgggctaacagagttaagcattgcattatttaactaataattttttcctgaacttcagattattatctgtatgtgtcatataacttgacaattttttttttttagtgctttttaaaaagagtgggatactttattcagtttagccctcaagcaattaggcaagtcagttaccatggtaacagtaggtattaatttccttacctagttrgaggttttatgaacaaagaaatctctgagttcatccaccaaaacccaactttctcttgagactggcctcttgagactggtgttaaatttgtctattttctagaagatgacactattctaagtggaaaatacggttctcttgaggtgaatttctactctatcaagagtgaagtagagtatggcttaaaagttaagtgattaaaaagctaccctttcttagctaatttggaatgtaattggtcttaatttttctaaattcgttctaaccaaaatcttattggcgtgatttctattgacatga

SEQ ID NO: 552 - DNA, 601 bp, Human
cattgcattatttaactaataattttttcctgaacttcagattattatctgtatgtgtcatataacttgacaattttttttttttagtgctttttaaaaagagtgggatactttattcagtttagccctcaagcaattaggcaagtcagttaccatggtaacagtaggtattaatttccttacctagttagaggttttatgaacaaagaaatctctgagttcatccaccaaaacccaactttctcttgagactggcctcttgagactggtgttaaatttgtctattttctagaagatgacrctattctaagtggaaaatacggttctcttgaggtgaatttctactctatcaagagtgaagtagagtatggcttaaaagttaagtgattaaaaagctaccctttcttagctaatttggaatgtaattggtcttaatttttctaaattcgttctaaccaaaatcttattggcgtgatttctattgacatgaactagaagtgacttcagcagacaacttgtcccaatatctaaatgctgtcaaatagaatcacttaagatgaatttcttccaaaacagagttcacaattttgacagataatct

SEQ ID NO: 553 - DNA, 601 bp, Human
tctactctaagtatagcagaaatttgttttccagctttataaatatatattttaagattaagaactgattttacttatataatctgggatcaacttttggcttctcctgtcaaggattttgaatttgtgacaaaatatacacttattgataaccagtgacatatataaaatgctttacaattaataaagcatatgtattttacatattttttcactacatatgacgcatgtggcaaccccaagagttgagttgtacccatcggcaaactttgatcatgattctgtgaatataggcaagcascaattgcaggtagaacattctttttttgagtcccaaaccgtgagaaacaaattacagaaatgtacctttcttttgcattaggacacgttgtagttttgtatgaacactctagttttaagcagtatgtgcaaaaacattgcacaaaggatttgtgtgttgattttgggactcctgtattattaattatgtggtttatttgactaccccacattttcaagcataaattaataaatccataattccaggcttattaacaataaacaatctagatagttgaactctttcttgctaacattttct

SEQ ID NO: 554 - DNA, 601 bp, Human
acaaaacaaatatgttctgttttttttttttaaatgcacacaccacgtttgagagattcttattcactgtattttctttaattatacttgaattttggtttacattgaggagtgccctcaaagatattaacagatttttaaaaaatcctctaaaaaactcattcttagggaaatttgttcacttactaggtgaggagcaaaataaaaatccttaatatagaagagctattatctgtcttcaaaattaagtctttgagtagatttgtgaataaatctaatagttttgctgaatttacttagctcttaagacagaataatcatgtagaaaatttaaaatgtcaggaattcataatgattcatatacccaaggattttcattgatagtgaggtaaggttattcttgagaaagactcaaagtcataaaataatagaatttcgaaactaccagaattatacaagtcaattaaaatgactgatttgttttaagaggaagaaatactaaatgtataattattagatgcagcatattgtatctgttttgttttgtgattctagctcttataacctatgcttggacctaggtgtcataacttactttaaa

SEQ ID NO: 555 - DNA, 601 bp, Human
acttgaattttggtttacattgaggagtgccctcaaagatattaacagatttttaaaaaatcctctaaaaaactcattcttagggaaatttgttcacttactaggtgaggagcaaaataaaaatccttaatatagaagagctattatctgtcttcaaaattaagtctttgagtagatttgtgaataaatctaatagttttgctgaatttacttagatcttaagacagaataatcatgtagaaaatttaaaatgtcaggaattcataatgattcatatacccaaggattttcattgatagtraggtaaggttattcttgagaaagactcaaagtcataaaataatagaatttcgaaactaccagaattatacaagtcaattaaaatgactgatttgttttaagaggaagaaatactaaatgtataattattagatgcagcatattgtatctgttttgttttgtgattctagctcttataacctatgcttggacctaggtgtcataacttactttaaatatgtatgtttggttttcattcatattgacagtactacctctcagttttctttcagatattgttttgtatttacccatgaagaca

SEQ ID NO: 556 - DNA, 601 bp, Human; identical to SEQ ID NO: 100

SEQ ID NO: 557 - DNA, 601 bp, Human; identical to SEQ ID NO: 101

SEQ ID NO: 558 - DNA, 601 bp, Human; identical to SEQ ID NO: 102

SEQ ID NO: 559 - DNA, 601 bp, Human; identical to SEQ ID NO: 103

SEQ ID NO: 560 - DNA, 601 bp, Human; identical to SEQ ID NO: 104

SEQ ID NO: 561 - DNA, 601 bp, Human; identical to SEQ ID NO: 105

SEQ ID NO: 562 - DNA, 601 bp, Human; identical to SEQ ID NO: 106

SEQ ID NO: 563 - DNA, 601 bp, Human; identical to SEQ ID NO: 107

SEQ ID NO: 564 - DNA, 601 bp, Human; identical to SEQ ID NO: 108

SEQ ID NO: 565 - DNA, 601 bp, Human; identical to SEQ ID NO: 109

SEQ ID NO: 566 - DNA, 601 bp, Human; identical to SEQ ID NO: 110

SEQ ID NO: 567 - DNA, 601 bp, Human; identical to SEQ ID NO: 111

SEQ ID NO: 568 - DNA, 601 bp, Human; identical to SEQ ID NO: 112

SEQ ID NO: 569 - DNA, 601 bp, Human; identical to SEQ ID NO: 113

SEQ ID NO: 570 - DNA, 601 bp, Human; identical to SEQ ID NO: 114

SEQ ID NO: 571 - DNA, 601 bp, Human; identical to SEQ ID NO: 115

SEQ ID NO: 572 - DNA, 601 bp, Human; identical to SEQ ID NO: 116

SEQ ID NO: 573 - DNA, 601 bp, Human; identical to SEQ ID NO: 117

SEQ ID NO: 574 - DNA, 601 bp, Human; identical to SEQ ID NO: 118

SEQ ID NO: 575 - DNA, 601 bp, Human; identical to SEQ ID NO: 119

SEQ ID NO: 576 - DNA, 601 bp, Human; identical to SEQ ID NO: 120

SEQ ID NO: 577 - DNA, 601 bp, Human; identical to SEQ ID NO: 121

SEQ ID NO: 578 - DNA, 601 bp, Human; identical to SEQ ID NO: 122

SEQ ID NO: 579 - DNA, 601 bp, Human; identical to SEQ ID NO: 123

SEQ ID NO: 580 - DNA, 601 bp, Human
ataaaagagcaaatggataatgtaaaaagagaactatttttttaaaaatgctaaagttggtatataatctattgaggaatataatagaacaaggcttgacaaaccttttctgaaaggaccagataataaatatttcaagctttataggccacatgtagtctgtatcacatattcctctctctgttttttcttttagtaaccctttaaaaatataaagagttacatttttcactggtgggccataacaaaacaggctgtgggccatatttgtccgaatgtcttctcagtgatctttcatccrtatgtccttttactctaggatgctgtgaaatcctggttaccccttcttgtatcacattgaaaacctaaagtttgaactattctatagaaattttattaaagcttttggtattagaatttccctttcttccctaattataaaaaatagcaaattttggccgggcatggtggctcacgcctgtagtcccagcactttgggaggccgaggtgggtggatcacctgaggtcaggagttcgagaccagcctggtcaacatggtgaaaccctgtctctactaaaaatacaacaattagctgggcgt

SEQ ID NO: 581 - DNA, 601 bp, Human
atgctgtgaaatcctggttaccccttcttgtatcacattgaaaacctaaagtttgaactattctatagaaattttattaaagcttttggtattagaatttccctttcttccctaattataaaaaatagcaaattttggccgggcatggtggctcacgcctgtagtcccagcactttgggaggccgaggtgggtggatcacctgaggtcaggagttcgagaccagcctggtcaacatggtgaaaccctgtctctactaaaaatacaacaattagctgggcgtggtggcaggtgcctgtaatsccagctacttgggaggctgaggcaggggaattgcttgaactcgggaggtggaggttgcagtgagccgagattgtgccattccactccagcctgggcaacaagagcgaaactctgtctcaaaaaaaaaaaaaaaaaaaaaaaaagtgaatttttacatgaatattctacatgattggcatatttacatgaatggtttaaaaacccacaataatagcactgttttattttttattttgaaaattgtagattcacaagaagttgtaaaaaaaaaaatacctatatagaggtcctatgtacctt

SEQ ID NO: 582 - DNA, 601 bp, Human
aataatggaaaagggtataggtaaatacgtaaaccagtaacatacttgtttattattcatcaagttatatactgtatataattgtatgtgctatactttttaatgcctggtagtgcagtaggtttattgacagcagcatcaccacaaacgtgagcagtgccttgtgctaagacattatgctggctatgacatcacttggtgataggaatttttcagctccattataatcttatgggaccactgttccacatgtgctctgtcattgacagaaatgccgttaagtaccacatgactatttttyggtggtctgttcctttttattattacagagtattccacagtatggttgtaccacagtttaactgatcacctgttgaagaacttttgggttgttttccagtttttgactattatgaataaagatgctatgaacatttgttcatatctcaaaggttctttatttttttttatttatttttctttttttgagacagtctggttctgtcaccctggctggaatgcagtggcgcgatctcggctcgctgcaagctccgcctcctgggttcacgccattctcctgcctcagcctcccgagtagctg

SEQ ID NO: 583 - DNA, 601 bp, Human
ataatggaaaagggtataggtaaatacgtaaaccagtaacatacttgtttattattcatcaagttatatactgtatataattgtatgtgctatactttttaatgcctggtagtgcagtaggtttattgacagcagcatcaccacaaacgtgagcagtgccttgtgctaagacattatgctggctatgacatcacttggtgataggaatttttcagctccattataatcttatgggaccactgttccacatgtgctctgtcattgacagaaatgccgttaagtaccacatgactatttttcrgtggtctgttcctttttattattacagagtattccacagtatggttgtaccacagtttaactgatcacctgttgaagaacttttgggttgttttccagtttttgactattatgaataaagatgctatgaacatttgttcatatctcaaaggttctttatttttttttatttatttttctttttttgagacagtctggttctgtcaccctggctggaatgcagtggcgcgatctcggctcgctgcaagctccgcctcctgggttcacgccattctcctgcctcagcctcccgagtagctga

SEQ ID NO: 584 - DNA, 601 bp, Human
gcaaaagtccttatgatgagttaccgatcctcatgtaatctggccttccattttccctctgatctcattctctactggtctcctcattcaccggatgcagccacaccaccctccttgtttttcttcggacattccaggcatgcttcagtgcctgggctttgcgcctgctgcttcctctccctgaatacgtttcccccacattgtctataggatgttctcccatacttctctcagatctcttggatttaggcctcctgggccaccatatttgaaatatcagattagttccccctcccccatyattcagcattcctcgtaaatctttgctgttttaaaaatagcactatcactgtctaacttactgtgttatattttgttaattttctgtgagttcttcttcactagaatattctttgtagggaggagtttttgattgtttggtttataaaatctggaacaatacctggcttataggaggtgctcaatttataatggggtgaatgaatgaatgaatgatgatgagaaagctgagaatcagtaaagtgactttccaaaacaggtagtgggcagtatagagttgggccataaatagctgcaccat

SEQ ID NO: 585 - DNA, 601 bp, Human
tagtactcatgtctctgaagttgttatatagaattctttttatttattttaataacaatatttatgatagttgaaactttttgagtgcttactatattttatttcatgcattatgttcagcactttacatgttttatctcacttgatattcacaactttatgagattggcactgttattgtagccattttatagatgaggaaactgaagcttagagagttaaataaagagctcaaaatctcacatctagtaagtggcaaaaacaggatttcagctcaagcaatctgattccaaaacagacytttttcactgtgctgccattcttttgcctggtttttctgttaacttcttaaatatatgtcatgtttcatgcttacttcctcattttcataaatatattacctgctcacttatacattatattgcttagaaacaaacccaaccctgttttcttatggactgtatcctgaaaatcactgtttttaatatgtggttaaacaagtgttttattagtgcatttatataaattatttaaccaaaacacttaaccggtgaaagtgctttactgtgagagtgagaatgtgcatgttctaagaacctct

SEQ ID NO: 586 - DNA, 601 bp, Human
ttgagtcatattctagaagtgcttctttgcaaattggtaaattgcacatacatttccacttatatacaagataattgctatggttggtttgtataatagatgcagtgcatctgaagagctattttatgagaatattgtttcttgtatctgtcacgagccaaaaagaatatttttaagaaagttatattcttggtgatagaacagctgataatttagaaacaactgtaagacagtccactttttctgattatgaaataataccatagttaagtgtaatttcctataatagaataaaaacacsagttctagttttaggggaggcatgttgttaccgtaccttagaatttctggaagatgacatattcatgcttttcctgataactgctgagtctcctgctctgtctgccaatccagtcaagaagcctttgctagcaatcaattaataatacgtttcatttatacatatttcctatatatagtatgttattgattatctcagtaccactgaagagaggttatctgggtcattggagctttgcttctagatttgtgaagccataaacctatatatttaaaataggaggccaaaaaaaaacgacca

SEQ ID NO: 587 - DNA, 601 bp, Human
agtcatattctagaagtgcttctttgcaaattggtaaattgcacatacatttccacttatatacaagataattgctatggttggtttgtataatagatgcagtgcatctgaagagctattttatgagaatattgtttcttgtatctgtcacgagccaaaaagaatatttttaagaaagttatattcttggtgatagaacagctgataatttagaaacaactgtaagacagtccactttttctgattatgaaataataccatagttaagtgtaatttcctataatagaataaaaacacgagwtctagttttaggggaggcatgttgttaccgtaccttagaatttctggaagatgacatattcatgcttttcctgataactgctgagtctcctgctctgtctgccaatccagtcaagaagcctttgctagcaatcaattaataatacgtttcatttatacatatttcctatatatagtatgttattgattatctcagtaccactgaagagaggttatctgggtcattggagctttgcttctagatttgtgaagccataaacctatatatttaaaataggaggccaaaaaaaaacgaccattg

SEQ ID NO: 588 - DNA, 601 bp, Human
attggtaaattgcacatacatttccacttatatacaagataattgctatggttggtttgtataatagatgcagtgcatctgaagagctattttatgagaatattgtttcttgtatctgtcacgagccaaaaagaatatttttaagaaagttatattcttggtgatagaacagctgataatttagaaacaactgtaagacagtccactttttctgattatgaaataataccatagttaagtgtaatttcctataatagaataaaaacacgagttctagttttaggggaggcatgttgttacygtaccttagaatttctggaagatgacatattcatgcttttcctgataactgctgagtctcctgctctgtctgccaatccagtcaagaagcctttgctagcaatcaattaataatacgtttcatttatacatatttcctatatatagtatgttattgattatctcagtaccactgaagagaggttatctgggtcattggagctttgcttctagatttgtgaagccataaacctatatatttaaaataggaggccaaaaaaaaacgaccattgctttatatagttagattttcagtgaattg

SEQ ID NO: 589 - DNA, 601 bp, Human
taatttcctataatagaataaaaacacgagttctagttttaggggaggcatgttgttaccgtaccttagaatttctggaagatgacatattcatgcttttcctgataactgctgagtctcctgctctgtctgccaatccagtcaagaagcctttgctagcaatcaattaataatacgtttcatttatacatatttcctatatatagtatgttattgattatctcagtaccactgaagagaggttatctgggtcattggagctttgcttctagatttgtgaagccataaacctatatatttmaaataggaggccaaaaaaaaacgaccattgctttatatagttagattttcagtgaattgagagtttatcatttgtaattatacattaatcaaatataaggcataatatacccccctgcttatatcagcaccatttcaaatgtaatgttaaaaaataataaatggagaagtagatagctaacaagtaggcttaatttaataagacaaagtaaatggcatttggaaacctcatggatttaatgttttatttaaatgatttctgatttttaaaaagtaaatattgtatccagaaggctgagaa

SEQ ID NO: 590 - DNA, 601 bp, Human; identical to SEQ ID NO: 124

SEQ ID NO: 591 - DNA, 601 bp, Human; identical to SEQ ID NO: 125

SEQ ID NO: 592 - DNA, 601 bp, Human; identical to SEQ ID NO: 126

SEQ ID NO: 593 - DNA, 601 bp, Human; identical to SEQ ID NO: 127

SEQ ID NO: 594 - DNA, 601 bp, Human; identical to SEQ ID NO: 128

SEQ ID NO: 595 - DNA, 601 bp, Human; identical to SEQ ID NO: 129

SEQ ID NO: 596 - DNA, 601 bp, Human; identical to SEQ ID NO: 130

SEQ ID NO: 597 - DNA, 601 bp, Human; identical to SEQ ID NO: 131

SEQ ID NO: 598 - DNA, 601 bp, Human; identical to SEQ ID NO: 132

SEQ ID NO: 599 - DNA, 601 bp, Human; identical to SEQ ID NO: 133

SEQ ID NO: 600 - DNA, 601 bp, Human; identical to SEQ ID NO: 134

SEQ ID NO: 601 - DNA, 601 bp, Human; identical to SEQ ID NO: 135

SEQ ID NO: 602 - DNA, 601 bp, Human; identical to SEQ ID NO: 136

SEQ ID NO: 603 - DNA, 601 bp, Human; identical to SEQ ID NO: 137

SEQ ID NO: 604 - DNA, 601 bp, Human; identical to SEQ ID NO: 138

SEQ ID NO: 605 - DNA, 601 bp, Human; identical to SEQ ID NO: 139

SEQ ID NO: 606 - DNA, 601 bp, Human; identical to SEQ ID NO: 140

SEQ ID NO: 607 - DNA, 601 bp, Human; identical to SEQ ID NO: 141

SEQ ID NO: 608 - DNA, 601 bp, Human; identical to SEQ ID NO: 142

SEQ ID NO: 609 - DNA, 601 bp, Human; identical to SEQ ID NO: 143

SEQ ID NO: 610 - DNA, 601 bp, Human; identical to SEQ ID NO: 144

SEQ ID NO: 611 - DNA, 601 bp, Human; identical to SEQ ID NO: 145

SEQ ID NO: 612 - DNA, 601 bp, Human; identical to SEQ ID NO: 146

SEQ ID NO: 613 - DNA, 601 bp, Human; identical to SEQ ID NO: 147

SEQ ID NO: 614 - DNA, 601 bp, Human; identical to SEQ ID NO: 148

SEQ ID NO: 615 - DNA, 601 bp, Human; identical to SEQ ID NO: 149

SEQ ID NO: 616 - DNA, 601 bp, Human; identical to SEQ ID NO: 150

SEQ ID NO: 617 - DNA, 601 bp, Human; identical to SEQ ID NO: 151

SEQ ID NO: 618 - DNA, 601 bp, Human; identical to SEQ ID NO: 152

SEQ ID NO: 619 - DNA, 601 bp, Human; identical to SEQ ID NO: 153

SEQ ID NO: 620 - DNA, 601 bp, Human
gatctgaattttctctcctccaatataaaaccccttcgtcttcctcttcttcttcttcatttttttttttttttttgtctgaagacttgtctcactgtgttgcccaggctggagtgtagtggtgcgatcactgctcactgcagccttgaccccctggactcaagctatcctcgcacctcagcctcccgagtagctgggactacagaacatgccaccatgctcagctaatttttgtattttttgtagagacagggttttgccatattgcctaggctggtcttgaactcctaagctcaagcartcttcccgcctcagtctccaaagttctggcactacaggtgtgagccactgtgcctggcctctttttctcatttaaatacttttcataccttttgtaaaacgggttccttgttgcctgtctatgccttcctcctccttcttaatgacaccacgttaattctgactgttttcccttggcctgttgcagaagcctcttaactattaacccttcattctctctctctgtttcatctgatatatgagtaccaaactaaatcttcctttatcatatcttacttctgcttaaatgttttttttctag

SEQ ID NO: 621 - DNA, 601 bp, Human; identical to SEQ ID NO: 154

SEQ ID NO: 622 - DNA, 601 bp, Human; identical to SEQ ID NO: 155

SEQ ID NO: 623 - DNA, 601 bp, Human; identical to SEQ ID NO: 156

SEQ ID NO: 624 - DNA, 601 bp, Human; identical to SEQ ID NO: 157

SEQ ID NO: 625 - DNA, 601 bp, Human; identical to SEQ ID NO: 158

SEQ ID NO: 626 - DNA, 601 bp, Human; identical to SEQ ID NO: 159

SEQ ID NO: 627 - DNA, 601 bp, Human; identical to SEQ ID NO: 160

SEQ ID NO: 628 - DNA, 601 bp, Human; identical to SEQ ID NO: 161

SEQ ID NO: 629 - DNA, 601 bp, Human; identical to SEQ ID NO: 162

SEQ ID NO: 630 - DNA, 601 bp, Human; identical to SEQ ID NO: 163

SEQ ID NO: 631 - DNA, 601 bp, Human; identical to SEQ ID NO: 164

SEQ ID NO: 632 - DNA, 601 bp, Human; identical to SEQ ID NO: 165

SEQ ID NO: 633 - DNA, 601 bp, Human; identical to SEQ ID NO: 166

SEQ ID NO: 634 - DNA, 601 bp, Human; identical to SEQ ID NO: 167

SEQ ID NO: 635 - DNA, 601 bp, Human; identical to SEQ ID NO: 168

SEQ ID NO: 636 - DNA, 601 bp, Human; identical to SEQ ID NO: 169

SEQ ID NO: 637 - DNA, 601 bp, Human; identical to SEQ ID NO: 170

SEQ ID NO: 638 - DNA, 601 bp, Human; identical to SEQ ID NO: 171

SEQ ID NO: 639 - DNA, 601 bp, Human; identical to SEQ ID NO: 172

SEQ ID NO: 640 - DNA, 601 bp, Human; identical to SEQ ID NO: 173

SEQ ID NO: 641 - DNA, 601 bp, Human; identical to SEQ ID NO: 174

SEQ ID NO: 642 - DNA, 601 bp, Human; identical to SEQ ID NO: 175

SEQ ID NO: 643 - DNA, 601 bp, Human; identical to SEQ ID NO: 176

SEQ ID NO: 644 - DNA, 601 bp, Human; identical to SEQ ID NO: 177

SEQ ID NO: 645 - DNA, 601 bp, Human; identical to SEQ ID NO: 178

SEQ ID NO: 646 - DNA, 601 bp, Human
catttccttttctccaagatgagaataatcatagtatctacttcctagggctattgtaagaataaaagaatgaaaaaattctcagaacagtgttttgtatatagttcagtaaatggtagtcattattattaaccttgttctgtggaggaggtgactgcggctcaagattattaggcaattttcccaaaaccacagtgcaaggggtagaaccagatcttgaatccagtgctcttcccgtcactgcttccagcagccatgtgatccaggtatggccactgatggacctcatcacatttcttcmggtcactagtctgctagaattgcatcccagtatcaattccgtagctgtgtatttcactcgttcccaaagcgttagttagcatactgcagaacgtatgctggtcctaagtgggactccttcaatttttagtgcctgcagatttcaaatcagggcctattgctagtagtgagtaatgtaatctgctttggagaggtaagaatcaatggttattccatgtataggtgaatgctttaaagcctcttccttcatgcgttcttttgataaaccacctaagagacactcttctgactgctaagaaat

SEQ ID NO: 647 - DNA, 601 bp, Human
gctagaattgcatcccagtatcaattccgtagctgtgtatttcactcgttcccaaagcgttagttagcatactgcagaacgtatgctggtcctaagtgggactccttcaatttttagtgcctgcagatttcaaatcagggcctattgctagtagtgagtaatgtaatctgctttggagaggtaagaatcaatggttattccatgtataggtgaatgctttaaagcctcttccttcatgcgttcttttgataaaccacctaagagacactcttctgactgctaagaaattcatgtgacaatrgtactgtttgtgctaccacacaagctcctaaggaaattccaactgttatgttcacttctacttcaattgtggggaaagttttccctttatccttctccccatacaaggtatacagctctcccatcctgtgttcatggggcttaagtttggagttgctgaaagctagggatcccacaggtattagaaacatccacactcagggcagcccagcactgagtcccttctactccattcctttacccacacaggaagtgatctgcaagtgggcatattttagttcacgcttagatcagcagtttc

SEQ ID NO: 648 - DNA, 601 bp, Human
gctcacttgttggaaactggtttaaatgctttttaaaccatcttggagatggttaaaactgggagactattgggaaggtacaattgcattttgccatgtgagaagagcatgagcttctgggatccaggagtggaataatacagtttggatgtttgttccctcaaaatctcatgttgaaaggtaatcctcaatgttggacatggggcctggtgagaagttttgggtcatgggggcagatccctcatgaatggcttggtgccctgcccatggtaatgagttcacatgtgatttggttttttttaaaaagcctggcactcccacctctctcttgccccctttcttaccatgtgatatacctgctccccctttgccttctgctgtgagtggaagcttattgaggccctcaccagaaacagatgctggcactatgcttttttttttttttttttttttttaacagtctgtagaactgtaagccaaatagacctatttccattataaatgaaaaaaaatttcataaggctatagctgccacagataatgatttctcttagggctgagcaaagtaaattgaataccttctaaaaaggattctaccatt

SEQ ID NO: 649 - DNA, 601 bp, Human
gttccctcaaaatctcatgttgaaaggtaatcctcaatgttggacatggggcctggtgagaagttttgggtcatgggggcagatccctcatgaatggcttggtgccctgcccatggtaatgagttcacatgtgatttggttttttttaaaaagcctggcactcccacctctctcttgccccctttcttaccatgtgatatacctgctccccctttgccttctgctgtgagtggaagcttattgaggccctcaccagaaacagatgctggcactatgcttttttttttttttttttttttttaacagtctgtagaactgtaagccaaatagacctatttccattataaatgaaaaaaaatttcataaggctatagctgccacagataatgatttctcttagggctgagcaaagtaaattgaataccttctaaaaaggattctaccatttctagatgctgttaaaacattcatgaatcatgaaataagtttaaaatataattgacaggagtatagaagaagttgatttcaaccatcagggatgactttgacgtgttcgagacttcagtggaggaagtcactgcagagatggtgaaaatagcaa

SEQ ID NO: 650 - DNA, 601 bp, Human
aataggaacttccggttaaccacagtttctattctacttctattaaaagaaataagcaaatgcaggaagaaagacttctaaagaaatattttagatctcctctggcactttgtatcttgatgaattgcgcatttactccaattgggcttttctgcttggttttgctgtgtgcattttgatggcgaaatctaaaaccgtgtggctgctgcactaacgtggtttactgccaagcagctggaccattataacggaaactctgagcttgtgagacacaaccactttttaaaaaaaatttaatttrcctttagaatcatgtcttatttttcagcaagaagttgtctttatatttcccactaatttcagaggaaacactgacaagttaaattttagcaattttaattaattaatcaaaacaaataaggtgattgtatagttggttctatttggctttcagctgtccatagagatgattaaacgttttggcaaaagtacaaaagctcagcagaatttgatagaccaactcttttctccactaatggacatggatgatacatagtctgggaaaggagaaagataaactgtttttgacagtggattaagg

SEQ ID NO: 651 - DNA, 601 bp, Human
gctaaatcccttgtcattgatggtgtagacaaggacaatggcttgagattatctccttccaacatcctattcagatgtacacatttacactctagcaagcacctggagtaatttctaaataattttatcatatcttaaataaactttctatttaatctaaatatggttattattttgaaggtttgccagtgataaacactgtagaaataaacacatagagactaaagttaaacagagttattttaccagagctgaagaggaatgcttaggtagactaacattatccttccaaagatgttcrtatgtaaagaatgaatactttacatatcggtagccagttttcccaacatcatttattaaatagggaattatttccccatttcttgtttttgtcaggtttatcaaatatcagatggttgtagatgtgtggtattatttctgagggctctgttctgttccattggtctatatctctgttttgataccagtaccatgctgttttggttactgtagccttgtagtatagtttgaagtcaggtagcgtgatgtagaaagctgaaactggatcccttccttacaccttatacaaaaattaattcaa

SEQ ID NO: 652 - DNA, 601 bp, Human
ctctccataggctttaccattgccagttggctttttttctgggttctgcatatgttttacagagtaagactctggtgctaattctgaataactgagaaccttattcacctctccaattctatgatccaaatgcttccatttccgtctacagtctagtccacaacctcttctcaatgaggactgtgtctgtctcctgtctcgcagcagggctccagtatgaaccatgctgtatagaatgcatgaaacagcagcctgtggagcaactgagagctgtctctctcctccttacatttgccgttamagagcacatgagtagtagctgcattaaagcagtgggaaaatccctgacccactttcccacctttcccttacttctacatcacacagccggaaacaaagttcggggagaagagagcatgaggaatgtacttcaaaagcatgtccacatcacacttgcacagcttctctccacatctgtgcttcttctgctctattttttgatacgataaggaatgtaccatcagcagaaaatggtgggtggttttaaatctatcatcaccttttcacataggagagaaccaaggtgcaaatggcattatac

SEQ ID NO: 653 - DNA, 601 bp, Human
tacttctacatcacacagccggaaacaaagttcggggagaagagagcatgaggaatgtacttcaaaagcatgtccacatcacacttgcacagcttctctccacatctgtgcttcttctgctctattttttgatacgataaggaatgtaccatcagcagaaaatggtgggtggttttaaatctatcatcaccttttcacataggagagaaccaaggtgcaaatggcattatacacattgtccctaagtttgggaaactggtgagcaataaagttggattaagtaaatgaatgattgggttgkgtcaacaccaagcccatgattctactgttcctcaaggaatgcttcagaccctatgttcactcaaaagtggcatgtgtattgaagtttagcttttctccttttcttcagcaaccaactagaccctcccaatcagccctgccccaggtcaggacataggacatgcaggggcatttagagggtattagaaaaaagaataatgatattggaagtatggggaggctgatgaagggaaaatgagtataacatgtttctagtacattcttctttctcttttaccatatgctctttcctgccacatag

SEQ ID NO: 654 - DNA, 601 bp, Human
gaaggacaatggcacaatggatgaaaattggtaaatatcagaaacctgtactcaagttagagaatattttattaattcaagcaagagatactaagaacttggaatcagccaacggtaatgtcaatgaaaaggaaatagcaagtatgacaggaactttgtgggcagaaccaactagaattagtatttcataagttgtggaagattaaggaaaatgaggagttggaaatggcttcaagatttccagccaggagactagaaggatgtttatggcattaactaagagaggagcttggtgaaaagraaaagatgtgaagaaataatattgtaggtggagaaaatgttgggttggatttataatatgtttcaagtataaataaaagcatgaacaaacgaacaatatgctccaagtttgtcaagaaacttaaagattgtcattttaatctttttcttgctgaaatttatagtcttaccaaaacccagttcttattgggagattaatgactaaatatatattaaactttctttctctaaaactctgttcctctctgtgggagataacaaccagcaaattatgaccatgaatcaagaaacctgtaatcaa

SEQ ID NO: 655 - DNA, 601 bp, Human
tttattaattcaagcaagagatactaagaacttggaatcagccaacggtaatgtcaatgaaaaggaaatagcaagtatgacaggaactttgtgggcagaaccaactagaattagtatttcataagttgtggaagattaaggaaaatgaggagttggaaatggcttcaagatttccagccaggagactagaaggatgtttatggcattaactaagagaggagcttggtgaaaaggaaaagatgtgaagaaataatattgtaggtggagaaaatgttgggttggatttataatatgtttcaartataaataaaagcatgaacaaacgaacaatatgctccaagtttgtcaagaaacttaaagattgtcattttaatctttttcttgctgaaatttatagtcttaccaaaacccagttcttattgggagattaatgactaaatatatattaaactttctttctctaaaactctgttcctctctgtgggagataacaaccagcaaattatgaccatgaatcaagaaacctgtaatcaaatagttcataactatgaacagttcataaacaaatcacggcttctttgaagcagactgtagattcaca

SEQ ID NO: 656 - DNA, 601 bp, Human
aaaatgaaaaacttttttttctgcaaaaacctctcttaaggtgattaaaaaacaagcttcaagctgaaagaaaaattgcaaaccacatatctagcaagatactagtatctagaatagataaagatttctcaaatctcaatagtaaaaaaaaaaatccattaaaaattgggcaaaacacagaagagatttgaccagaaaggatatacagatacaaataagcacatgaaaagatgtcaaaaccattagccattaaggaaattaaaattgcactgaaatatcattacataactatcagaatggytaaaataaaaaatagtgacaacacaaaattcagaaaagatagagaaactgaatgactcattgctggcaggaatgtaaagtggtacaatcactctagaaaacagttttgtagtttctaaaaaactaaaaatgtaattttcatatgatccagtaatttcactcctaagcatttattccagataaataaaaacttaagttcacatgaaaacccacacatgaacattcataacagctgtatccatgatagccaaaattggaagcaatctagatgtccttcaacaaatgaatggttgaaaaactg

SEQ ID NO: 657 - DNA, 601 bp, Human
attgccaggaggtaaggaggaggtgagagtgagagggaagtgagcatgtctgtaaaagagcaataggagggatccttgtggtgatgaagacatcctgtatcttgactatatcaatgtcaatctcatgcctgtggtactatagttttgcaagatgttgccattggggaaaactgggtaaaggctaaagatgatccctctgtattatttcttacaacttcgtgctaatctacaattatctcaaaatagaaaatttaattaaaaagtcaaaacaaaagtgtgctgtttctctgcctaaggggaytggagaaattacacgggggcccagaaaataagaaagcaagagcccactcaatcctggctaaggaattagaaacaaagaagaaactaggaagcaagacaagatttccttcttatgactcggtagagctgacagttgagcccgacgtggaaggttaggtggttgggttatggtcaactgccatttgccatatgctcactgtattagtcagggttttgtacaaaaccagcaagatgtgtacatagacagagacatttattttaaggaggtgtgtgtgtgtgtgtgtgtgtgtgtgtgtgcatt

SEQ ID NO: 658 - DNA, 601 bp, Human
aacttcgtgctaatctacaattatctcaaaatagaaaatttaattaaaaagtcaaaacaaaagtgtgctgtttctctgcctaaggggattggagaaattacacgggggcccagaaaataagaaagcaagagcccactcaatcctggctaaggaattagaaacaaagaagaaactaggaagcaagacaagatttccttcttatgactcggtagagctgacagttgagcccgacgtggaaggttaggtggttgggttatggtcaactgccatttgccatatgctcactgtattagtcagggtyttgtacaaaaccagcaagatgtgtacatagacagagacatttattttaaggaggtgtgtgtgtgtgtgtgtgtgtgtgtgtgtgcattcaagcaagtcaagttttaaaaactaggaaaaaaaaccatgactcacctggtgggaaaagatagttataaccatcagacaaggcatcctatgcttccatgctgtctttaacactagcagaaaaagtaacttaaaaactctgctgcaagatgactggctgttttctaaactatctgaagttctctcaggccatctgtgggataactccatttta

SEQ ID NO: 659 - DNA, 601 bp, Human
tatccagttttacatgctcattttggtcctttccaccgcaccccccttccgaaatagttcttccacacttatcatggttctactacacttatcatggtgctacttcttcatgtggtgttatcccctccctgtgtgctcagctttgccagtctttctaagctgtctattggccttttctgtatctttccctgtgggttagattttcaaggccattggtcatgtctgctacttatctctgaactccttccattttgcctacacttctcaggtagtgagctgctcaccagagtataacagaagraacacacagtctcccaagattatgatggaattcttggggtatgctatttagtaattttaaaaaattaatttcccatttaagatttgaatataattttatgtctatgaataactttagttgtatttcttctccctggatctatctttctagttcaagaagttattcgtgaaagtatttctccaactgtattagctttagtttttagaaagtgtcctattatttgtatcatttactttttttcttttttctttttttttttttttgaggcagagtctcactctgtcacccaggctggagtgc

SEQ ID NO: 660 - DNA, 601 bp, Human
cttcatgtggtgttatcccctccctgtgtgctcagctttgccagtctttctaagctgtctattggccttttctgtatctttccctgtgggttagattttcaaggccattggtcatgtctgctacttatctctgaactccttccattttgcctacacttctcaggtagtgagctgctcaccagagtataacagaaggaacacacagtctcccaagattatgatggaattcttggggtatgctatttagtaattttaaaaaattaatttcccatttaagatttgaatataattttatgtctaygaataactttagttgtatttcttctccctggatctatctttctagttcaagaagttattcgtgaaagtatttctccaactgtattagctttagtttttagaaagtgtcctattatttgtatcatttactttttttcttttttctttttttttttttttgaggcagagtctcactctgtcacccaggctggagtgcagtcatgcaatcttggctcactgcaacctccgcctcttaggcttaagccatcctcccacctcagcctcctgagtagctgggaatacaggtgggtgccatcaggcc

SEQ ID NO: 661 - DNA, 601 bp, Human
aaagtactttgcaaattacgtagttttctagtttgtcaggggaaaaatgttctcaagtgtgtcttatataagaatgattattccagactatttgaattatagaagtacatataattttagaatttttaggaaatgtgaagtaagcaataaaaagaatcttcaaataatattattaattcaaatgtatatattcatagcaattttttttttaagaataagacatatcactctatgtgaggtagtaaataccaaaacaaacaaaattcactggttttgtcaaagaacaaaataaaaccaatcraaacaaaactcttcttgtccatccaggcagctgaggaaggcaggaaggcaggtaaggtcagttcactgaaaatcaaatgttttaccaaaagcaaagaaccatttattaaaaaaagtcttgtgaccaccaaaagaactaccataaacaagaagctgtcatggccacgtgtgcctgtaatcctagcactttgggaggccaaggtgggcagataactagagctgaggagttcaagggcaccctgggcaacatggggaggattatgccatgttgtgtgtgtgtgtgtgtgtgtgtgtgtgtgtg

SEQ ID NO: 662 - DNA, 601 bp, Human
agtttgtcaggggaaaaatgttctcaagtgtgtcttatataagaatgattattccagactatttgaattatagaagtacatataattttagaatttttaggaaatgtgaagtaagcaataaaaagaatcttcaaataatattattaattcaaatgtatatattcatagcaattttttttttaagaataagacatatcactctatgtgaggtagtaaataccaaaacaaacaaaattcactggttttgtcaaagaacaaaataaaaccaatcaaaacaaaactcttcttgtccatccaggcmgctgaggaaggcaggaaggcaggtaaggtcagttcactgaaaatcaaatgttttaccaaaagcaaagaaccatttattaaaaaaagtcttgtgaccaccaaaagaactaccataaacaagaagctgtcatggccacgtgtgcctgtaatcctagcactttgggaggccaaggtgggcagataactagagctgaggagttcaagggcaccctgggcaacatggggaggattatgccatgttgtgtgtgtgtgtgtgtgtgtgtgtgtgtgtgtgtgtgtgtgtctcgagcagattctggct

SEQ ID NO: 663 - DNA, 601 bp, Human
ttcttgtccatccaggcagctgaggaaggcaggaaggcaggtaaggtcagttcactgaaaatcaaatgttttaccaaaagcaaagaaccatttattaaaaaaagtcttgtgaccaccaaaagaactaccataaacaagaagctgtcatggccacgtgtgcctgtaatcctagcactttgggaggccaaggtgggcagataactagagctgaggagttcaagggcaccctgggcaacatggggaggattatgccatgttgtgtgtgtgtgtgtgtgtgtgtgtgtgtgtgtgtgtgtgtgtstcgagcagattctggctgccccagactcactaatgctgcctcctggttgtatgttctccaggagatagttttggatccttcatctattataaaatgcattttgtgtgattttcttccttttgcattatattgcatgttatcaatttaaggaaataatcctttggaattgttaaaaaaacaaataggaagctgtgatgtgacaatgaaaaattgctgggtcttaaaacatttgtaaattgtggattttaggatattgaacatgatatttatcaaccttgaataaggacaaaaattattcat

SEQ ID NO: 664 - DNA, 601 bp, Human
ccttttgcattatattgcatgttatcaatttaaggaaataatcctttggaattgttaaaaaaacaaataggaagctgtgatgtgacaatgaaaaattgctgggtcttaaaacatttgtaaattgtggattttaggatattgaacatgatatttatcaaccttgaataaggacaaaaattattcatagaagagagaatacactaaacaaatgttgtctacttgtatctgacaggaaaggttttcctctttttaaaaagataaatcataggtccagccctgccaaagagcaacactgaatcaytgcacgtaactgaagcattgacttgtttttcacctgaaagttttcagaatatgctatgtttattaccaaatggtagagcaggtataataaaaatagacaccaaccatcctcctaggaaagacttgagtagaaagtaatgtgattctcaatgcctttcacacaaaagacacatatggtaattagtttattctcctcatgtacggtgtaaatagcaaaatgtgactgagtggttattgtaggcactctttccttagaaagagtttcattagagtttgaaagtatttctgggaaaacatcaag

SEQ ID NO: 665 - DNA, 601 bp, Human
tccataccacccccaaaaatttttcaccatcccaacactttaccactatttcattttatttttcttattaatataagaagacaggaatgtcaggcctctgagcccaagctaagccatcatatcccctgtgacctgcacgtacacatccagatggccggttcctgccttaactgatgacattccaccacaaaaagaagtgaaaatggcctgtttctgccttaactgatgacattgtcttgtgaaattccttctcctggctcatcctggctcaaaagctcccccactgagtaccttgtgaccsccactcctgcccgccagagaacaacccccctttgactgtaattttcctatacctacccaaatcctataaaatggccccacccctatctccccttgctgactctcttttcggactcagcccgcctgcacccaggtgaaataaacagccatgttgctgacaaaaagcctgtttggtggtctcttcacacggacgcgagtgaaagtaagaattctttattaaaatacagtcatcacaggacatccatatgtctctgtctcagtctgcctgtctgtctgtctgtctaatctatttatcttattt

SEQ ID NO: 666 - DNA, 601 bp, Human
ccaaaaatttttcaccatcccaacactttaccactatttcattttatttttcttattaatataagaagacaggaatgtcaggcctctgagcccaagctaagccatcatatcccctgtgacctgcacgtacacatccagatggccggttcctgccttaactgatgacattccaccacaaaaagaagtgaaaatggcctgtttctgccttaactgatgacattgtcttgtgaaattccttctcctggctcatcctggctcaaaagctcccccactgagtaccttgtgacccccactcctgccygccagagaacaacccccctttgactgtaattttcctatacctacccaaatcctataaaatggccccacccctatctccccttgctgactctcttttcggactcagcccgcctgcacccaggtgaaataaacagccatgttgctgacaaaaagcctgtttggtggtctcttcacacggacgcgagtgaaagtaagaattctttattaaaatacagtcatcacaggacatccatatgtctctgtctcagtctgcctgtctgtctgtctgtctaatctatttatcttatttgtctatctttct

SEQ ID NO: 667 - DNA, 601 bp, Human
ataagaagacaggaatgtcaggcctctgagcccaagctaagccatcatatcccctgtgacctgcacgtacacatccagatggccggttcctgccttaactgatgacattccaccacaaaaagaagtgaaaatggcctgtttctgccttaactgatgacattgtcttgtgaaattccttctcctggctcatcctggctcaaaagctcccccactgagtaccttgtgacccccactcctgcccgccagagaacaacccccctttgactgtaattttcctatacctacccaaatcctataaaayggccccacccctatctccccttgctgactctcttttcggactcagcccgcctgcacccaggtgaaataaacagccatgttgctgacaaaaagcctgtttggtggtctcttcacacggacgcgagtgaaagtaagaattctttattaaaatacagtcatcacaggacatccatatgtctctgtctcagtctgcctgtctgtctgtctgtctaatctatttatcttatttgtctatctttctatgaatctaatctatctattctatcatctatcatctctctatcatctatcatctatccac

SEQ ID NO: 668 - DNA, 601 bp, Human
tctgccttaactgatgacattgtcttgtgaaattccttctcctggctcatcctggctcaaaagctcccccactgagtaccttgtgacccccactcctgcccgccagagaacaacccccctttgactgtaattttcctatacctacccaaatcctataaaatggccccacccctatctccccttgctgactctcttttcggactcagcccgcctgcacccaggtgaaataaacagccatgttgctgacaaaaagcctgtttggtggtctcttcacacggacgcgagtgaaagtaagaattckttattaaaatacagtcatcacaggacatccatatgtctctgtctcagtctgcctgtctgtctgtctgtctaatctatttatcttatttgtctatctttctatgaatctaatctatctattctatcatctatcatctctctatcatctatcatctatccacgtgtttatcctatctatctctatctatctatctatctatctatctatctatctatctatctattatctctctctctctctctcctatatctgctttcagaggtattgtgggtatatttatagggactaaaatagaaaaga

SEQ ID NO: 669 - DNA, 601 bp, Human
gtgaaataaacagccatgttgctgacaaaaagcctgtttggtggtctcttcacacggacgcgagtgaaagtaagaattctttattaaaatacagtcatcacaggacatccatatgtctctgtctcagtctgcctgtctgtctgtctgtctaatctatttatcttatttgtctatctttctatgaatctaatctatctattctatcatctatcatctctctatcatctatcatctatccacgtgtttatcctatctatctctatctatctatctatctatctatctatctatctatctatccattatctctctctctctctctcctatatctgctttcagaggtattgtgggtatatttatagggactaaaatagaaaagacccatatagtatactgtgatgcaaatcaagttattctcagcatatagtgttcggtttgccctgccttcttttgggaattgtatctctcgtcttctgggaaccattctttccaccactgcagccataacagagctctcatggttttatccaaagttgtcatttcccggctacaaaaattagtccaaggatgtcactacttcaggctgagccagtcataaccc

SEQ ID NO: 670 - DNA, 601 bp, Human
gaaataaacagccatgttgctgacaaaaagcctgtttggtggtctcttcacacggacgcgagtgaaagtaagaattctttattaaaatacagtcatcacaggacatccatatgtctctgtctcagtctgcctgtctgtctgtctgtctaatctatttatcttatttgtctatctttctatgaatctaatctatctattctatcatctatcatctctctatcatctatcatctatccacgtgtttatcctatctatctctatctatctatctatctatctatctatctatctatctatctactatctctctctctctctctcctatatctgctttcagaggtattgtgggtatatttatagggactaaaatagaaaagacccatatagtatactgtgatgcaaatcaagttattctcagcatatagtgttcggtttgccctgccttcttttgggaattgtatctctcgtcttctgggaaccattctttccaccactgcagccataacagagctctcatggttttatccaaagttgtcatttcccggctacaaaaattagtccaaggatgtcactacttcaggctgagccagtcataaccctt

SEQ ID NO: 671 - DNA, 601 bp, Human
aaacagccatgttgctgacaaaaagcctgtttggtggtctcttcacacggacgcgagtgaaagtaagaattctttattaaaatacagtcatcacaggacatccatatgtctctgtctcagtctgcctgtctgtctgtctgtctaatctatttatcttatttgtctatctttctatgaatctaatctatctattctatcatctatcatctctctatcatctatcatctatccacgtgtttatcctatctatctctatctatctatctatctatctatctatctatctatctatctattatcactctctctctctctcctatatctgctttcagaggtattgtgggtatatttatagggactaaaatagaaaagacccatatagtatactgtgatgcaaatcaagttattctcagcatatagtgttcggtttgccctgccttcttttgggaattgtatctctcgtcttctgggaaccattctttccaccactgcagccataacagagctctcatggttttatccaaagttgtcatttcccggctacaaaaattagtccaaggatgtcactacttcaggctgagccagtcataacccttcccca

SEQ ID NO: 672 - DNA, 601 bp, Human
ctgacaaaaagcctgtttggtggtctcttcacacggacgcgagtgaaagtaagaattctttattaaaatacagtcatcacaggacatccatatgtctctgtctcagtctgcctgtctgtctgtctgtctaatctatttatcttatttgtctatctttctatgaatctaatctatctattctatcatctatcatctctctatcatctatcatctatccacgtgtttatcctatctatctctatctatctatctatctatctatctatctatctatctatctattatctctctctctctctcccctatatctgctttcagaggtattgtgggtatatttatagggactaaaatagaaaagacccatatagtatactgtgatgcaaatcaagttattctcagcatatagtgttcggtttgccctgccttcttttgggaattgtatctctcgtcttctgggaaccattctttccaccactgcagccataacagagctctcatggttttatccaaagttgtcatttcccggctacaaaaattagtccaaggatgtcactacttcaggctgagccagtcataacccttccccaggattttaaaaact

SEQ ID NO: 673 - DNA, 601 bp, Human
cttaggtaaatgtaaagccttaaagccttatccattgctgggaaaagataactggaagaacatatcctgtggctattaggtaagaagcactatgaaactttttttctagttagaaaagtgtgtgtgtgtgtgtctgtgtgtgtgagtgtgtgtgtgtattcatcgagggctgtggtggaggcagagtgtgggactgaacagtggaggactatgcattcaaactagggaaacttattgtattaggattccccagaaaaactaaaccaataggagatgtgtgtgtgtgtgtgtgtgtgtgtgygtgtgcgcgcgcgcgcacgcacgtgcacgtgcgcatgctcgtgtgtgatttagatctttaaactgattagatgaggcccacccacattagggatggcaatctacattcctcagtctactgatttcaatgctagtctcatccaaaaataacctcacagacacatctagatggaggactatctccatttactgaccacagcatgactgtgtgaagatctgtctcaagcactttcacacacattgtcttacgttgacctcatgtcaacccttagatgtaatttccattttacagatgaaagaa

SEQ ID NO: 674 - DNA, 601 bp, Human
taggtaaatgtaaagccttaaagccttatccattgctgggaaaagataactggaagaacatatcctgtggctattaggtaagaagcactatgaaactttttttctagttagaaaagtgtgtgtgtgtgtgtctgtgtgtgtgagtgtgtgtgtgtattcatcgagggctgtggtggaggcagagtgtgggactgaacagtggaggactatgcattcaaactagggaaacttattgtattaggattccccagaaaaactaaaccaataggagatgtgtgtgtgtgtgtgtgtgtgtgtgtgygtgcgcgcgcgcgcacgcacgtgcacgtgcgcatgctcgtgtgtgatttagatctttaaactgattagatgaggcccacccacattagggatggcaatctacattcctcagtctactgatttcaatgctagtctcatccaaaaataacctcacagacacatctagatggaggactatctccatttactgaccacagcatgactgtgtgaagatctgtctcaagcactttcacacacattgtcttacgttgacctcatgtcaacccttagatgtaatttccattttacagatgaaagaact

SEQ ID NO: 675 - DNA, 601 bp, Human
taaatgtaaagccttaaagccttatccattgctgggaaaagataactggaagaacatatcctgtggctattaggtaagaagcactatgaaactttttttctagttagaaaagtgtgtgtgtgtgtgtctgtgtgtgtgagtgtgtgtgtgtattcatcgagggctgtggtggaggcagagtgtgggactgaacagtggaggactatgcattcaaactagggaaacttattgtattaggattccccagaaaaactaaaccaataggagatgtgtgtgtgtgtgtgtgtgtgtgtgtgtgtgygcgcgcgcgcacgcacgtgcacgtgcgcatgctcgtgtgtgatttagatctttaaactgattagatgaggcccacccacattagggatggcaatctacattcctcagtctactgatttcaatgctagtctcatccaaaaataacctcacagacacatctagatggaggactatctccatttactgaccacagcatgactgtgtgaagatctgtctcaagcactttcacacacattgtcttacgttgacctcatgtcaacccttagatgtaatttccattttacagatgaaagaactatgg

SEQ ID NO: 676 - DNA, 601 bp, Human
aaatgtaaagccttaaagccttatccattgctgggaaaagataactggaagaacatatcctgtggctattaggtaagaagcactatgaaactttttttctagttagaaaagtgtgtgtgtgtgtgtctgtgtgtgtgagtgtgtgtgtgtattcatcgagggctgtggtggaggcagagtgtgggactgaacagtggaggactatgcattcaaactagggaaacttattgtattaggattccccagaaaaactaaaccaataggagatgtgtgtgtgtgtgtgtgtgtgtgtgtgtgtgctcgcgcgcgcacgcacgtgcacgtgcgcatgctcgtgtgtgatttagatctttaaactgattagatgaggcccacccacattagggatggcaatctacattcctcagtctactgatttcaatgctagtctcatccaaaaataacctcacagacacatctagatggaggactatctccatttactgaccacagcatgactgtgtgaagatctgtctcaagcactttcacacacattgtcttacgttgacctcatgtcaacccttagatgtaatttccattttacagatgaaagaactatggt

SEQ ID NO: 677 - DNA, 601 bp, Human
actttcaatactatgttaaataaaaatggtgaaagtgggcatccttatcttcttccagatattagaggaaaagctttcaacttttcccatttcactatgatgttagctgtgagtttgttatatatggcctttattgtgttgaagtgtgcttcttttatgccccatttgttgagtttttaatcatgaagggatgttttctcaaatgatttttctgtgcttatagaaatgatcatatgggttttgtcttgtttacttttgtggttttgtggatttttatagtgctaagctttgattcctttckctttctcatttgtgactctgctgcatttttttcatgattgccctgaggcttacattaataaatattatagttatagatgactattttaatctaataacaacttaattttggtagcatataaatattctagacttttaccctcccagccacactggtaatttttttttgctttaatttacatatttttatattgtgtaatccttaacaactaattttaggtatggttattgtagaccattttgactttcaccttcatactagagatttaaagattatatctcatcattaaagtaatagagt

SEQ ID NO: 678 - DNA, 601 bp, Human
tcaaaactgacttatttcaaaaaccctgttgtaagttaaaaaattctttcttctgcttgatctagtctgctgttgaagttaccaactgtatttttaattttttattgaagtcttcagtcccaagatttgttttttaaattgatatttatctctgttaaatgtctcattcagataataaattgtttttctgatttgttgaattgtctatctgtgtcctcttgtatcttgctgagtttccttaagttcattatttttaatttataaactacgatttctttggggtcagttactagagaattastgtgtttctttgataaaatcatgtctcattgatttttcatgtttcttgtatccctgcattgataatatctgtgtgtctggtggaacaatcacctcttccaattttatagggtagctatcatagaaaaaaatttttgcttgttgtcttgtcctagggtgttggttgggtaaggtgcattgtctttggttcctggtgtgtgtagtgtaacacctgtgcagtttcttcagcagtattaaatgtcagtgatgcctgtgagtgcctcagtggcctaggctggaggagtttgtgcagctgctctgc

SEQ ID NO: 679 - DNA, 601 bp, Human
agatacatgatgcatactaagccaccagggaagtatctgagtgggcttagtaatatgtcttccaccacttgtattaaattttacaaactaaaaacagccaataaagagaaatgtttttctgaagcatctatgtatatctcaagctttggcacgtaaagacaagctgacttggcaaaagaagtgagatttagagtctgaaagcctgtgtttgaggctggcctctgtcatttagttcctgacttaatgtcattaggaaattggtaatgaccatattatctgctggaagcttgggaaggaaaarggaagttgatttgctgatttcttacaatgagtcagtgatgttattatatttacatatgactaatttaattctcaaaaatgctgagaaaattagacattatcttcatttaacagatggggaatatgatatgcagttactaatggcagaggtaaatttgaaccaaattctattcaataatagaagctgtgttcatttcattatacgaaactgcctacaaataagaagtttgtgaaactcatatacatgtaagttagtattataaatagaatgtcaaaatgtgtcccatttttaactgagact

SEQ ID NO: 680 - DNA, 601 bp, Human
aagggaagccagcctggaatgaagaggtgaccttaccagaggacctaccagaaactgtaggtcctatacatccagaatgaataaagacagatcacagatataactaccatgtaagactacttttttctctcctaatactgccatccctacgcctaactctggaggagtcagaaacatcagctagagtgtggggaagaaaaactgaccagccctatctcccctatctccactgtagttttctctgctggagtctaaagggggaaaaggttttaggttgaaagaatttcggagttacgtgctwattacactctcttaaacattttaattccagaaatgagattgttcttgtgaatgcaaaggtgccttccccagacattatcaggcagtgtggaagaaccagtttacaaaatgagtttaaaggaaatgatgagaatgaatgaaagtgcttgtgatttctccctcaagaggtgagatcattcacacaccagctttacaattatccaaagtgtggacttgccaatggtcctcattcacactcactaggttgtggttgatgttaaaggtcaggtggttgaggtttcttggtgtggaattagagatc

SEQ ID NO: 681 - DNA, 601 bp, Human
ttattgacccaaactcagaaatggtctctgtcaatcgtaaggtcacataggaggactgctgatggatggtcaagccaaaatatctctttaaaagcttttggtatgccatgtataaactcatacttgcttaagaaatttctgcaaaacagatattgcagccacatattagagcaatctggtaaagcagtctgtagtgctgacatggtaaaagaaagtcctgtgatgagatattttgttaacaggtgttatgtgttttttgaaatgaggattttccaataaaaaacaagccccatattcccartaactgaattatctcctagcaggaagatcacactgctttcataaataacatatcctcacaatgaatagtttcatataaaaaatgtcaaatactcaagttcagagaaagagtggagcttggtggcatatgttggtcacatggcttctcaaactagttctcaaaaatccatgtttttgtcaccatccctagatattctaattccagagacttggaatggggtctaagaatctgtatgtttcataagcacatcagcgattgtgctgcatgtggtcctcggcgtccactgagaaacactggtat

SEQ ID NO: 682 - DNA, 601 bp, Human
gtattcgatttctcttttatctgactcatctaagcaaatctattatggagcaatttagcttataaatgtagttattctaaatttccctaaacatttatacagtatatatcaactcagcaagacttccactaacaagttcaagtctaaatcagttagtacaaactttgaattgaaatcacaaggttaacctgtcacttaaaaatatttattttattgtagtaagaatgcttaacatgggtagatctctaccctcttaatatatttttaaagtacacaatacagtattattaactataggtaytatgttgtacagcagacctatagaacttacttaccttctataactgaaactttatgcctgttgattggcaactcccatttccccttcccctcaacttctggtaaccactattctactctccgactccatgagtttgattattttagatacttcatataagtgcaatcatgagctacttgtccttctgtcactggcttatttcacttagcataaagttttcaaatttcatccctgttgctaaatgttgcaaaatttcttccttttttaaggctgaatattattcctctgtattattaataa

SEQ ID NO: 683 - DNA, 601 bp, Human
caacagtatacaaggactgcaatttcttcatgtttttgcccatacttatcttttttttttttgataatagtcatcctaagagatgtgaggtgacatctaattatggttttgatttgcatttacctgatgattagtgatggacattttttcatatacctgtgttgcccatttgtatgccttctttggagaaatgtctattgaagtttttagcccatttttaaactggattagtttttttttttgttattgagttgtaggagttccttatatattttgggtatttatgccttctcagatatayagtttacaaatattttcttccatttcataagttgccttttgctctgttgattatttcctttgctgtgcagaaactttttagactgatgtaattacatttgtctgttttttcttttgttgctgtgctattggtgtcatatttataatccttgtcaataccaatgtcatgaagcttttctccaacattttcttctattagttttacagtatcagttcttacgtttaagtctttaatccattttgagttgatttttgtttatggtgtaagctaagggtccaatttcagtcttttgtaggtgga

SEQ ID NO: 684 - DNA, 601 bp, Human
actccttgatagagtaagtaccatatgttggctctagtcacctttcataccctgtatcccattgctcagacctcaactctggtttctcacatccacatcttcagcagggaatacgtgattagagaggacatgtgaacactgtacccaaggattcacgtactgtggctataccatcatgctaatgccctatcctaagtgtgctaacctacctcatctccttcccaaagcttcccactaagtgttttcaattgcttaagtaaactgtgtgacttgagcatcttaatttagtctgtgagccttkctaggatagcttgcttgaaaatatacttggaggttatttttacatgaaggtaatgtctcatacgacattacccttctcgtgtttttgcttttactctgttgctcactttctgatttcttcttaaaggtatctaaagtttaagcttccttctaggaactgctctaggcatgttccataaatttagagatgtaatggtttctttattgaagtagtattaatacagttggccctccatagttgtggattccacacctgcagattgaaccaactatggatgaaaaatatgtttaaaagacagta

SEQ ID NO: 685 - DNA, 601 bp, Human
atttagatatgtttattgcctccaacatcggattgcttaggctgcaattttgctattaatttctatttttttgcattatgatcagagatctttggcatggtattcattcttttcttttttgttttttaattttatgtttattgtggcactattcacaacagcaaagacttggaaccaacccaaatgtccaacaatgatagactggtattaattctttagaattaatggagattgtctttaggatcttaaacatggctttttagtaaacattctctgcatatttaaaagaatgcatgtttcrtgtttgttgagtatagtgtttggtatatttttaattgcttgagattgaatgttgtatttttcaggtattttaccatactgctaatattttatttgtttgatctagcatatgtgttaaagtcctcaattacaactgataaatcatctgtagggtctgaatgtttgtgttctctgaaaattcatatgttaaaacttaatccccaatgtgacagtattaagaggtggggcctttcggggagtgattaagtcatgagtgtgcctccctcatgaatggaatttgtgctcttttttttttaatttt

SEQ ID NO: 686 - DNA, 601 bp, Human
acatcggattgcttaggctgcaattttgctattaatttctatttttttgcattatgatcagagatctttggcatggtattcattcttttcttttttgttttttaattttatgtttattgtggcactattcacaacagcaaagacttggaaccaacccaaatgtccaacaatgatagactggtattaattctttagaattaatggagattgtctttaggatcttaaacatggctttttagtaaacattctctgcatatttaaaagaatgcatgtttcatgtttgttgagtatagtgtttggyatatttttaattgcttgagattgaatgttgtatttttcaggtattttaccatactgctaatattttatttgtttgatctagcatatgtgttaaagtcctcaattacaactgataaatcatctgtagggtctgaatgtttgtgttctctgaaaattcatatgttaaaacttaatccccaatgtgacagtattaagaggtggggcctttcggggagtgattaagtcatgagtgtgcctccctcatgaatggaatttgtgctcttttttttttaatttttttattatactttaaggtttaggg

SEQ ID NO: 687 - DNA, 601 bp, Human
tagcaacagtattaagtgcagccctgactacttatatgtagcttttttgcaggcctgaaattaggactggtgtgtccattgagaaaccatggaaagtttcccaaaacatgttttgtctcttaaatatctgcacaaagacgacattcaaagtatagaagctgcaaactagtgttgtgtttgaaaaactctctggctaaaaataaaaatcaccactatggaaagaaactcttgaaactacagaaaaataaatttcatctgaagatcccttttggttgaaggaatctatggacattcaattaarttaattttggaccaaaaagatacatgttgtgaattatctctcttctcttaacctatgagaacttactatgtaatattttttagagctaaaaaacgggaacagccttacccgtgagaggctggctggtacagtaggaccaccaagatggcaatttaaaaagcagagcctttgggtatccttgattcaaatcctagctcagctacttactaactgtgtgatcgtggtagacaatttattcaatttctcttccatgtaattttctcatcactcaaatgggcataaagagaggattcataatgt

SEQ ID NO: 688 - DNA, 601 bp, Human; identical to SEQ ID NO: 315

SEQ ID NO: 689 - DNA, 601 bp, Human; identical to SEQ ID NO: 267

SEQ ID NO: 690 - DNA, 601 bp, Human; identical to SEQ ID NO: 268

SEQ ID NO: 691 - DNA, 601 bp, Human; identical to SEQ ID NO: 269

SEQ ID NO: 692 - DNA, 601 bp, Human; identical to SEQ ID NO: 270

SEQ ID NO: 693 - DNA, 601 bp, Human; identical to SEQ ID NO: 271

SEQ ID NO: 694 - DNA, 601 bp, Human; identical to SEQ ID NO: 272

SEQ ID NO: 695 - DNA, 601 bp, Human; identical to SEQ ID NO: 273

SEQ ID NO: 696 - DNA, 601 bp, Human; identical to SEQ ID NO: 274

SEQ ID NO: 697 - DNA, 601 bp, Human; identical to SEQ ID NO: 275

SEQ ID NO: 698 - DNA, 601 bp, Human; identical to SEQ ID NO: 276

SEQ ID NO: 699 - DNA, 601 bp, Human; identical to SEQ ID NO: 277

SEQ ID NO: 700 - DNA, 601 bp, Human; identical to SEQ ID NO: 278

SEQ ID NO: 701 - DNA, 601 bp, Human; identical to SEQ ID NO: 279

SEQ ID NO: 702 - DNA, 601 bp, Human; identical to SEQ ID NO: 280

SEQ ID NO: 703 - DNA, 601 bp, Human; identical to SEQ ID NO: 281

SEQ ID NO: 704 - DNA, 601 bp, Human; identical to SEQ ID NO: 282

SEQ ID NO: 705 - DNA, 601 bp, Human; identical to SEQ ID NO: 283

SEQ ID NO: 706 - DNA, 601 bp, Human; identical to SEQ ID NO: 284

SEQ ID NO: 707 - DNA, 601 bp, Human; identical to SEQ ID NO: 285

SEQ ID NO: 708 - DNA, 601 bp, Human; identical to SEQ ID NO: 286

SEQ ID NO: 709 - DNA, 601 bp, Human; identical to SEQ ID NO: 287

SEQ ID NO: 710 - DNA, 601 bp, Human; identical to SEQ ID NO: 288

SEQ ID NO: 711 - DNA, 601 bp, Human; identical to SEQ ID NO: 289

SEQ ID NO: 712 - DNA, 601 bp, Human; identical to SEQ ID NO: 290

SEQ ID NO: 713 - DNA, 601 bp, Human; identical to SEQ ID NO: 291

SEQ ID NO: 714 - DNA, 601 bp, Human; identical to SEQ ID NO: 292

SEQ ID NO: 715 - DNA, 601 bp, Human; identical to SEQ ID NO: 293

SEQ ID NO: 716 - DNA, 601 bp, Human; identical to SEQ ID NO: 294

SEQ ID NO: 717 - DNA, 601 bp, Human
gctcctcctctgtcctcccctgccagtttatttgcttcatccagtagttggctgatgatttccaaacttggcagcacagaagaaatatccagggtatattcctcggctccacctcatacctactgactctctagtaccatgtggacagtagctatttcatatttatgaaatctcccctgttgattctgaagtgcagccaggattggaaatcactgtgaaaaacagtatcttgagtataaagagagaagactgatgacaaatatgggttattctgaacaactctcaggacaattctggtagraaaaatccagaatggttctcagtaatggagctaaatgatttcagctctcctgttctctatagtactcaaatagaaggaggacagtcaccatatttgcttgttgcaattgtgcatgtgggcatgagtttcagagatgtatgtcctgttgccctaacttttgcatttcctgtgtcattataaaccttttccaaagcataatgacacaaaacatgatcatatttatatggttcattagcaaaagggaatagctactcataggagagatgactgggccaagcccaacttggcaacagaatgaag

SEQ ID NO: 718 - DNA, 601 bp, Human
tccacatttgcattaggataaaacatatggattcaccaattttgcagaacaaaaattatcaaatattcctaatttcatactcaatctaataaacagttatatcattaaactattttgaatcattcaattaaagtgcagtccattaacaaataaggaaaagatttgttgttaaaattaaggaaagcaggtttgcaaaggagaaagcagagaagtacttggggactttttgggatgaaaatatttactgagggcaaaataactattaaataatagaggctgcaattataaattatttaaacastggattgataaataaaaatttctgtaaagtaaatggttacttggtatcacagcaccaaagtgatttgatttttaaaaaattaatctggtagatgtggaaaactaatcaaccagtttggtgttactaagccctcactgatttacagagacacatgtgacaatgcaaaggaaagaacaaaaactgagagtaaggagacctgaatttgagtgcctgctccccgctccaatcagttatatgatttgaggcaaattgctttgcctttttatcctcaagtttctgatctgtaaaatgaggagtcag

SEQ ID NO: 719 - DNA, 601 bp, Human
gggaccatcagtagagactggaatatgagagtgagtgaacaagggatatttatttctccacttccttttgtggggttgccataggctggccgtgtcctaagacagaagtcttcagtttccgcagggcctcctttaccacaccacctctctgtcttcgggttcatatacctttccctccacttgtccattcaggcctggggtgataatagtccctactgttactagattccagcgtattgtctccacatttgcattaggataaaacatatggattcaccaattttgcagaacaaaaattatmaaatattcctaatttcatactcaatctaataaacagttatatcattaaactattttgaatcattcaattaaagtgcagtccattaacaaataaggaaaagatttgttgttaaaattaaggaaagcaggtttgcaaaggagaaagcagagaagtacttggggactttttgggatgaaaatatttactgagggcaaaataactattaaataatagaggctgcaattataaattatttaaacactggattgataaataaaaatttctgtaaagtaaatggttacttggtatcacagcaccaaa

SEQ ID NO: 720 - DNA, 601 bp, Human
acagcaaccttgtgagcaatcacttgtaatattaggcccttgggagttttgaaaagctttatgcttctttgggctccaggacaaccgctgggaagtgagcagagcagtttttgttattctcattagatgcataaagctacatggtttctataatttagtagcaaactcagaaaaaaacctgaattttgactatttcaggaagataggttgaacaagatctcacagtggataagaagtcccttttacatttacagatgggagacagggagatatgggtgtgagactcccaaaaaaagaagasaaagagtctattcaagaattatgatacttcgtaatgtgactgagcatgctcccagatcaatgtagttgattattcaaaaacggaagcctcatttcttggcctgctccgtacagagagtaactttcctacggtttctactcttaatgggaaatggagagccaaaatgtgactgttttctgcagagagattcttagttaattgcttctacctctgttttcacctcagtggggttcagcttccctaattaactgtagtgggcatgtctggttataggcggcgatcacttcggaatggctgagc

SEQ ID NO: 721 - DNA, 601 bp, Human
gtgctagtcatgtcataaagataagcttctttcctttctttcaaacatactttaagaatgcctagtgtgtttgggtgaatcaatctcactcctctatacacagaagaaagtttcctgttaatttctctggctccctaaatctcacactcatattctcctaggaaatcaggtgcctagtggcagagccaggtccctagacacctgcttatggggtttattaaaggttactaggtgatacaggagctgcagggcatatgtgttttgacttagtggtggctgggggacagcctatgtgctgtgkctggcagagtccctgggcatgtctacccctaaaaagcctacgaaagtggaaacatctagcaatgacaataatgagactgccaagagcaattaatagagtaacagatttgttggaaaagtcaagtacagagacctagggagttagtcataaggtgagagttgacagcaaccttgtgagcaatcacttgtaatattaggcccttgggagttttgaaaagctttatgcttctttgggctccaggacaaccgctgggaagtgagcagagcagtttttgttattctcattagatgcataaagcta

SEQ ID NO: 722 - DNA, 601 bp, Human
ttatttcctctgggtgaagtgtatgcttcacaatctacagacatgaattaagttttgtcattgtagttattttgttttagtctatgctgtttatatgtatttgaggagggacatgtgtttccaaattttctcttatggaagaaacagacatttgaaaatatgcaagaggcacagtgtgttctcacatatgatattgccccattgatcattgtaagtggcttgttattggtggcttgttttcattttgtctaacttcagagggaaatgggcccttttaggcatatagagaaaaatatccaarttttttgcctctttgttttctgtagaaaaaaaaaaacagtttgaaagaggtaaaaatgtgaccaaaccccatatgtgtggttgcaagactcacaaagctatttccatgtgagacttggctcattgtgagggatcatgaaggggatgtcacagatatgtttccaaaatagtataaattcatttcagcctgagggctaaaagttacatttttggtggtcaataagtacttgattgatgggataaaattctatctttaaaatgttttattgtttttccttaggaagtttgctctcatatagct

SEQ ID NO: 723 - DNA, 601 bp, Human
ggcattactgtctctgcattgtccttcaaatgcatcatacactttcgttcccaatctagttttttccataagctactgaaatagatcatttcaatctggttttatttaccattgacctctcatctcaaaaactctgctatctcggttacctctgtcacatttacatactgtcccttgcaccagcctcccttgggctgggcaggagtccagtttccaccctgggttttgtcttctctagtgtcttggctctgagcatccattctaagctaatcttcctgtgactacctaagaagaagctcckacacagcctggtggctcaatcgttctgaaaaaataaaggttagaagacattcatgttgctttccagaacttggaactcatttgactttacttatataagaggctatagaaaataggactcgattgtttcagtttctgaggtgcaaagtgctcaggtttccagtaaaaactaatctctctgcattgtgcctttcagaaccagataaaaaaaattagagagaaatttatttctaaaaaatgacaagtatcctgctagcttcctttagatgcagcaagaacaatgcttttaattctgcctcct

SEQ ID NO: 724 - DNA, 601 bp, Human
agtttcacacctcctgtgctgtatcacacagaaatgaacaaggtgccacagttagtaattgacaggtgataaagccctaatgataaagctaacaacgataatacaaataatgacagctgatttttgagagttgtgtgtcagatgacgttttgtggactttaggcatattagcttatttttcacagacagctttatgagaaaggtactattatgatctccattttatacattaggaaagcaaggcacagttaggttaagtaacttactcaatattaaagattcatctgttaagtagaagagygaggacttagatcctgaagttcagcaagaacaatgatgtaatctggagtaatccagctaagcacaacaaatatcaaatcgagtgtcacttcacaacgttccagcaatgatccaacataccctaacggagtgtgcaaacctctaccatctcaattggaagctctttgacaataaaaacaaatatataacaaattctgcactaagttcatgacagccttctcaaagcaggggaagctaactgcaaattttgagatgaagactttctgtgtaaaacatgtcacaagataccatttgtaagtca

SEQ ID NO: 725 - DNA, 601 bp, Human
gcagacataagaaagaatgagatcatatcctttgcagcaacataaatgcatctggaggccattatcttaaatttatgaatgcaagaacaggaaaacatgtatcacatgttctctgttacaagtgagagttaaacattgatcacacaaggacataaacatggaaacaacagggactggggactactagaggcaagagggagagaggaaggtatgtgttgaaaaaccagttattgggtactatgctcactacctgagtgacaggacctgtaccccaaacctcaactccacgcaagatgcccaygtaaaagcctacatgagattctgcatctctaaccgaagcccaggtgatgctgatgcagaccacatcttggaagaatttagggttcagagagagtctcctcagtacttgttgcagtgaatttactgcaactcctgttgttgtaaactcctgttgcagtaaactcacaacccaatgagaaacatcctgactttgattcacatatattttaaaacctcataaggaggaattacaggcctttttgtcaaaataccagttcagttgataaactaagggacaaaaagaccctcggctcacctggaa

SEQ ID NO: 726 - DNA, 601 bp, Human
tgtctgaatcaaatatactcagagtcccttctttccacccctccatcccaaactgtatttcctcagaaaaagagcaattacagagaaaacaaacaaacacacaaacaaaaaaatgatggaaagggtcccacttcatggggtcatcacacaagtttcgtttttcaccagtcagcctttgtccatgagaaataatttgagactctgattcagaaggtgtggtgtggggcttgagattctgcatttcttatttatttatttaagcataataatcttttaattttattttttagttttttaaatktctccttttattacagatacagaagatacatatacaccatggaataccatgcagacataagaaagaatgagatcatatcctttgcagcaacataaatgcatctggaggccattatcttaaatttatgaatgcaagaacaggaaaacatgtatcacatgttctctgttacaagtgagagttaaacattgatcacacaaggacataaacatggaaacaacagggactggggactactagaggcaagagggagagaggaaggtatgtgttgaaaaaccagttattgggtactatgctcactac

SEQ ID NO: 727 - DNA, 601 bp, Human
ttcatctggaacaaagtttactgtggttcattactcaagtgttaaacaacttccaaatgtcaaacaagggacaatggaaaaacctcctttaaagattagtaaaggtgccctaatcctaccttgagatgttctgttttctctgtcagacctcttaaagtaaatacatttgatatgaggtattctagcttgttggaatgctctatgaagggtatggctgttagatcatcttttcattcatacactaaataatacatattaaacaagtatgatgtgctcatggactccacattcacatggttaygtggtcagtgaaagactacacacaagtatatacacagaatctgaggcccctcttctctgactcttttctttttgagatttatttccttcacttttggggagctgtagctgccctaaattctgtcttatattattcaagtcagtaaaattgagagttttctatcagagttttacttgtcctggaaagggataaaaccaagggaactctactcacaactatctccattttaaagtctcatcttctttctagcatctccctgtcttggtctctctccagggtcttcagataatttctttttat

SEQ ID NO: 728 - DNA, 601 bp, Human
tctactttattccaacttttctatttttggcgggctgcaatacaggctactttacagtaaaagaggtggctgactgttgatttacttttcaaattcgcatggacaaaactgaggcaaaatgaagagcctgaagagtatcttctctgtttctttagttactagagggccaaataaatatgtttggaaacttacagcaaacaactaaaaccacattccccactatacaaacatattaataaataaaatatttaaaaattatttcgaaatggtctaaatagtaccaactccacaatactttgcmctgaatcaaagctgccaattttatttctgccaagttttgtttcaaaacagaaataaacttttctatatgttcagcatgatctctaatgattaaagatagttatttacatttccctgaagcttctaaaaatgttttcttatcagtttgctttagcacagagggaagagtgtgaagtgatgtttacttgaacaggtgaagaagaatcaataagtcaatttctaaatattttacctgaaggaaaagacattttaagagagactgaatgataaagatttgtggtctatgttggttaaattggcc

SEQ ID NO: 729 - DNA, 601 bp, Human
tatgttattaatattaaataatctacccagtttgtgtgaaaatttataaggaacagattagcagattctgccaaagtcaaacacattctactttattccaacttttctatttttggcgggctgcaatacaggctactttacagtaaaagaggtggctgactgttgatttacttttcaaattcgcatggacaaaactgaggcaaaatgaagagcctgaagagtatcttctctgtttctttagttactagagggccaaataaatatgtttggaaacttacagcaaacaactaaaaccacattmcccactatacaaacatattaataaataaaatatttaaaaattatttcgaaatggtctaaatagtaccaactccacaatactttgcactgaatcaaagctgccaattttatttctgccaagttttgtttcaaaacagaaataaacttttctatatgttcagcatgatctctaatgattaaagatagttatttacatttccctgaagcttctaaaaatgttttcttatcagtttgctttagcacagagggaagagtgtgaagtgatgtttacttgaacaggtgaagaagaatcaataagtca

SEQ ID NO: 730 - DNA, 601 bp, Human
cagtggctaagtttgatgcagtaactgtgcttgcatttttgtgtccaatcctgggctagggctgcaaaaataaagttcaatgcttgcaatcaaagaagttaccttccggtggggagacagatacataaacaaataagtgccactatgtacaatgatttctaaaaaaagtaatttttgtagcctattttaagacagttaaaaattctcttctcagttaagtcagaggagaaaaaatggatcagactagtggggcttatgttattaatattaaataatctacccagtttgtgtgaaaatttayaaggaacagattagcagattctgccaaagtcaaacacattctactttattccaacttttctatttttggcgggctgcaatacaggctactttacagtaaaagaggtggctgactgttgatttacttttcaaattcgcatggacaaaactgaggcaaaatgaagagcctgaagagtatcttctctgtttctttagttactagagggccaaataaatatgtttggaaacttacagcaaacaactaaaaccacattccccactatacaaacatattaataaataaaatatttaaaaattattt

SEQ ID NO: 731 - DNA, 601 bp, Human
caggcattaaacaaaatgatggggcctcttgattagggttagtccttaccttcattctgagatggtttcttaattagcagcatggggtattaaggaagtcactcagatcagatcaaataagctaagcaactttccactagctttctaaagataagtcacaccagtgtaattttgtttaagtagtatgatcttccaaattgcaagacaaaaatctgcactcaaataatataaatgcatcacttccaagtaaaacaagaaatacttgaagccaaaaatagataaaatttgtgagttatactcyattttattttcttcattaatataaaaagagataattgccactgtgaatgatatgtaagtgaaagccatattatccactttggcttcaatgagtcatatcactattcagtgcccttactaccagttcatgttttaataaaacatacagtttgttgagcagtatgtaactttcaagcggaagggatccttcagttttttaattgggtacactatttaatctatcttttccacaaaatgccccaaagggcatttataataatttgattaaaaatggaatcagaattatagaacacaggttttc

SEQ ID NO: 732 - DNA, 601 bp, Human
taattattgttattttcagtagttatggtctataaagttgcttcaaaaactgaaatagcaaatactgagccattgcttctagggaaaacacatggttaggttcctgtaagcctctggtcacaaatattttcacccagcaatcaatagctaactttgttttatgtgttttgtttaaagacaacttatttaacatatgttgctgcttcattcacactgaactctcaaccaatagcactattacttctacctgaagaaaactccaacacacacatattctctgtaagccacatcacagctttcytgtacttaggaacatcatacagcacttcagtactatgcttgaggggctatttaaaacaataaaatcaccaaccaatttacaaattcataaaaatgtaaaaattgtggcactaaatagaccacaaaaaggacatttgttcgtagtatgagaactgaaacaagaaggcacagagagcattgccttctttaacctcagctgggagctgtacatcaggtggctccaatttctggacattctgtgaatgtctgtgaatgatagcaaatctgctaggagtattgatttgggggttacaaacaattt

SEQ ID NO: 733 - DNA, 601 bp, Human; identical to SEQ ID NO: 295

SEQ ID NO: 734 - DNA, 601 bp, Human; identical to SEQ ID NO: 296

SEQ ID NO: 735 - DNA, 601 bp, Human; identical to SEQ ID NO: 297

SEQ ID NO: 736 - DNA, 601 bp, Human; identical to SEQ ID NO: 298

SEQ ID NO: 737 - DNA, 601 bp, Human; identical to SEQ ID NO: 299

SEQ ID NO: 738 - DNA, 601 bp, Human; identical to SEQ ID NO: 300

SEQ ID NO: 739 - DNA, 601 bp, Human; identical to SEQ ID NO: 301

SEQ ID NO: 740 - DNA, 601 bp, Human; identical to SEQ ID NO: 302

SEQ ID NO: 741 - DNA, 601 bp, Human; identical to SEQ ID NO: 303

SEQ ID NO: 742 - DNA, 601 bp, Human; identical to SEQ ID NO: 304

SEQ ID NO: 743 - DNA, 601 bp, Human; identical to SEQ ID NO: 305

SEQ ID NO: 744 - DNA, 601 bp, Human; identical to SEQ ID NO: 306

SEQ ID NO: 745 - DNA, 601 bp, Human; identical to SEQ ID NO: 307

SEQ ID NO: 746 - DNA, 601 bp, Human; identical to SEQ ID NO: 308

SEQ ID NO: 747 - DNA, 601 bp, Human; identical to SEQ ID NO: 309

SEQ ID NO: 748 - DNA, 601 bp, Human; identical to SEQ ID NO: 310

SEQ ID NO: 749 - DNA, 601 bp, Human; identical to SEQ ID NO: 311

SEQ ID NO: 750 - DNA, 601 bp, Human; identical to SEQ ID NO: 312

SEQ ID NO: 751 - DNA, 601 bp, Human; identical to SEQ ID NO: 313

SEQ ID NO: 752 - DNA, 601 bp, Human; identical to SEQ ID NO: 314

SEQ ID NO: 753 - DNA, 601 bp, Human; identical to SEQ ID NO: 315

SEQ ID NO: 754 - DNA, 601 bp, Human
catggacattgtacagatgaggtcaccaagaccccagccgctttagtaacttgccctaaggtgccgcccacttgggagtccgtggggcagcaggactagagcccaggcaatcccacgccagagccagctgctctccatctctcaatcacgtttgaggagcccccacaataaccagaatctccgggagatttgcttaaaatgcagattcccaggtccttgccctgagattcagattcagtaaacccaggaatctgatctttattttatttttaaaaatttattttataaagatggtgtctcmctatgttgtccaggctggcctcaagtgatcctcccacctcggcctcccaaaatgctgggattacaggtgtgagccactgagccctgattttttttttaaacaaaatctggatttcttagacttaagcaagataggggaccactagtttgtctgcttctggggttcaaggaatgcccccaggccagcgctaaccctgctccagttctagtctctccccttccccagccctctgggaggcatgacccactgcacttccctgcccccagtagcctatgaggagcccaaggcatttgctgggac

SEQ ID NO: 755 - DNA, 601 bp, Human
gccgcccacttgggagtccgtggggcagcaggactagagcccaggcaatcccacgccagagccagctgctctccatctctcaatcacgtttgaggagcccccacaataaccagaatctccgggagatttgcttaaaatgcagattcccaggtccttgccctgagattcagattcagtaaacccaggaatctgatctttattttatttttaaaaatttattttataaagatggtgtctcactatgttgtccaggctggcctcaagtgatcctcccacctcggcctcccaaaatgctgggatkacaggtgtgagccactgagccctgattttttttttaaacaaaatctggatttcttagacttaagcaagataggggaccactagtttgtctgcttctggggttcaaggaatgcccccaggccagcgctaaccctgctccagttctagtctctccccttccccagccctctgggaggcatgacccactgcacttccctgcccccagtagcctatgaggagcccaaggcatttgctgggacctcagtgcctttatcaaaatcccaaagtccaatggggaaacaggctcaggtgtaggtttggc

SEQ ID NO: 756 - DNA, 601 bp, Human
aaaatgctgggattacaggtgtgagccactgagccctgattttttttttaaacaaaatctggatttcttagacttaagcaagataggggaccactagtttgtctgcttctggggttcaaggaatgcccccaggccagcgctaaccctgctccagttctagtctctccccttccccagccctctgggaggcatgacccactgcacttccctgcccccagtagcctatgaggagcccaaggcatttgctgggacctcagtgcctttatcaaaatcccaaagtccaatggggaaacaggctcakgtgtaggtttggccagggtgtcctgcacattagggcattccagggtcctgcaggggtttcttagaactcggctagcccagcccatgaatgggaggtgacctgctaagccactcattcactcactagcactcattcagctcctgcgaggccctgggtggtgttctgggcactggtgcttgcctcaaggagcaccccctctgcaggaagacagacgtgagggctgggagggtgcggatgcaccagcggctgcaggaccacaagccagaggggatcagctcttcaaagggcactgggccaggc

SEQ ID NO: 757 - DNA, 601 bp, Human
ggaaacaggctcaggtgtaggtttggccagggtgtcctgcacattagggcattccagggtcctgcaggggtttcttagaactcggctagcccagcccatgaatgggaggtgacctgctaagccactcattcactcactagcactcattcagctcctgcgaggccctgggtggtgttctgggcactggtgcttgcctcaaggagcaccccctctgcaggaagacagacgtgagggctgggagggtgcggatgcaccagcggctgcaggaccacaagccagaggggatcagctcttcaaaggkcactgggccaggcttcccagcacccagggaccctgagctagccttgtgagtagagcaggggagtctggcaggtagaggatgggaggtaaagggaggcacagagtgggcggaggctgggaagtgtgaaagggcactgtgtacagaacctagggagtaagcagaagccagagatggatggaaagttgggctgggctgcattgtggaaagccttgaatgccatgccaaggaacttgggccagtgtattcaccttggcttgagttgtaaaagcaacaatgcagattcctgggccccaccctggg

SEQ ID NO: 758 - DNA, 601 bp, Human
gccagaggggatcagctcttcaaagggcactgggccaggcttcccagcacccagggaccctgagctagccttgtgagtagagcaggggagtctggcaggtagaggatgggaggtaaagggaggcacagagtgggcggaggctgggaagtgtgaaagggcactgtgtacagaacctagggagtaagcagaagccagagatggatggaaagttgggctgggctgcattgtggaaagccttgaatgccatgccaaggaacttgggccagtgtattcaccttggcttgagttgtaaaagcaacartgcagattcctgggccccaccctgggcctctggatctgaatctggagggagacgctggggaggcagcagggaggaaaacctgcagtcactcaccccagttacaacacatgcagttaccggcaggtccgagataacctaagggtttccaaatgctaggaagtgactcaatgactgatatgtttaatacaatacaatcccggttgcaaaatgcccagggcaagggtgggggtgttcagttttctaatgctcccagttcaaaaaggagctgaaatgaattgtcaaagaagtgacaagctgggc

SEQ ID NO: 759 - DNA, 601 bp, Human
gtagaggatgggaggtaaagggaggcacagagtgggcggaggctgggaagtgtgaaagggcactgtgtacagaacctagggagtaagcagaagccagagatggatggaaagttgggctgggctgcattgtggaaagccttgaatgccatgccaaggaacttgggccagtgtattcaccttggcttgagttgtaaaagcaacaatgcagattcctgggccccaccctgggcctctggatctgaatctggagggagacgctggggaggcagcagggaggaaaacctgcagtcactcaccccakttacaacacatgcagttaccggcaggtccgagataacctaagggtttccaaatgctaggaagtgactcaatgactgatatgtttaatacaatacaatcccggttgcaaaatgcccagggcaagggtgggggtgttcagttttctaatgctcccagttcaaaaaggagctgaaatgaattgtcaaagaagtgacaagctgggcgcagtgactcacacctgtaatcccagcactttgggaggctgagagaggatcgcttgaacccaggagtttgagaccagcctgggcaacatagtgagatc

SEQ ID NO: 760 - DNA, 601 bp, Human
gagccatggtctctctctatttcccaggctggagcacagtggcacaatcatagctcactgtagcatccaatacctgggttcaagtaatccttccacctcagcctcctgagtagctgggactacaggtgtgtgccaccacggctggctaattgtttttatatttttagagacaggatcttgctatgttgcctaggctagtcttgaactgctggtctcaagcagtcctcctgcctcagcctcctaaagtgttggatttatagatgcgagcaaacgtgcctggcctaaatgaataaatctttaytgttgcctcctttgagctttattggttgggatttagtccactcattttgcaggtgagaactgagacccggagatgaatgcagtagccttgcctcaggtccacatctgagggacagactccatcctacttttcttcccatgtattctttcctgcttgtaccagttcactggggtgaccaagaaagacatttctgagttttcctcctggctggcacagtggagacatgcccagccacgtttagctagacttaccatggctgggctagaagagaggccaggagcttgtctggaggttgcacag

SEQ ID NO: 761 - DNA, 601 bp, Human
agggctgtgaacctagaagctccagagtcctcagtcctcaccatggtgtttaaacacaataaaatctatgcctgagtgctgaagacacacctgccatttagatcgatccacttttttacattgtcggtgtactccctgccatccatctgcccagaaatactgtgaatgtgggcagcgcaggactggttcctccaagccccattttacagacagtccaatcattttacatattattttatgaatgagcaccttcctcagtgtctcagaccaggggtccccacacagcagggccacacagcargaggtgagtggcaggtgagtgagcgaagttttatctgtatttacagctgctccccatcgctcgcattaccacccaagctcggccacctgtcaggtcagctgaggcattagatgattctcacaggagcacaaacccttttgtgaactgcacatgtgagggatctgggttgcgtactttttcttttttttttaagacggagtttcgctcttgtcgcccagactggagtgcaatggtgcgatcttggctcactgcaatctccacctccccatgttcaagtgattctcctgcctcagcctggtg

SEQ ID NO: 762 - DNA, 601 bp, Human
tagaagctccagagtcctcagtcctcaccatggtgtttaaacacaataaaatctatgcctgagtgctgaagacacacctgccatttagatcgatccacttttttacattgtcggtgtactccctgccatccatctgcccagaaatactgtgaatgtgggcagcgcaggactggttcctccaagccccattttacagacagtccaatcattttacatattattttatgaatgagcaccttcctcagtgtctcagaccaggggtccccacacagcagggccacacagcaggaggtgagtggcrggtgagtgagcgaagttttatctgtatttacagctgctccccatcgctcgcattaccacccaagctcggccacctgtcaggtcagctgaggcattagatgattctcacaggagcacaaacccttttgtgaactgcacatgtgagggatctgggttgcgtactttttcttttttttttaagacggagtttcgctcttgtcgcccagactggagtgcaatggtgcgatcttggctcactgcaatctccacctccccatgttcaagtgattctcctgcctcagcctggtggctgggattacag

SEQ ID NO: 763 - DNA, 601 bp, Human
ggccacctgtcaggtcagctgaggcattagatgattctcacaggagcacaaacccttttgtgaactgcacatgtgagggatctgggttgcgtactttttcttttttttttaagacggagtttcgctcttgtcgcccagactggagtgcaatggtgcgatcttggctcactgcaatctccacctccccatgttcaagtgattctcctgcctcagcctggtggctgggattacaggcctgtgctatcacacccagctaatttttgtatttttagtagagacagggtttcactgtgttggccargctggtgtcgaactcctggcctcaggtgatccacctgcctcagtctcccaaagtgctgggattacaggcatgagccactgcacgcggccctgggtgcgtgcttcttatgagactctaatgcctgatgatctgtcactgtctcccatcgcccttggatgggaccatctaattgcaggaaaataagctcagggctcccactgattctgcattatggtgagttgtataattatttcattatatgttaccatataataataatagaaataaagtacgtaatacatgtaatgtgcttgaatcatc

SEQ ID NO: 764 - DNA, 601 bp, Human
cactgattctgcattatggtgagttgtataattatttcattatatgttaccatataataataatagaaataaagtacgtaatacatgtaatgtgcttgaatcatcccgaagccatggccccaaccacggcctctggcagtggaggctggagtccacatcacgctctgtgctgggtgcaggaatggagatgagtgggtgtcctgctcatttccctgaggaggaacctgaggctcaggctagagacttacctgggtgacacggctcctaagtggcagagtccagattcaaacccagggctacrgacccagaagcctgtgcatttaaccacggttctgagctatccagcccaaagaggagagtttaaaaggattacatttcttcgttggaaatcagtgagcatagtcgcccagaaccatttttgaaaaactcagagaaggcctatgttttcctgaagcggccagggaagtattctgcctttttaaaagggaagactgaattctagggaggagaggcaccagctctctgggctgggcaggtctccaagctggcagggccacagcctcccgacggtcttgcctctagcatatttcttccagaagcc

SEQ ID NO: 765 - DNA, 601 bp, Human
atacatgtaatgtgcttgaatcatcccgaagccatggccccaaccacggcctctggcagtggaggctggagtccacatcacgctctgtgctgggtgcaggaatggagatgagtgggtgtcctgctcatttccctgaggaggaacctgaggctcaggctagagacttacctgggtgacacggctcctaagtggcagagtccagattcaaacccagggctacagacccagaagcctgtgcatttaaccacggttctgagctatccagcccaaagaggagagtttaaaaggattacatttcttsgttggaaatcagtgagcatagtcgcccagaaccatttttgaaaaactcagagaaggcctatgttttcctgaagcggccagggaagtattctgcctttttaaaagggaagactgaattctagggaggagaggcaccagctctctgggctgggcaggtctccaagctggcagggccacagcctcccgacggtcttgcctctagcatatttcttccagaagccacatttccacaggtgggcagctctaactgggagaaaatcttcctgagatttagccaaattagctttctttctttcttttt

SEQ ID NO: 766 - DNA, 601 bp, Human
atgttttcctgaagcggccagggaagtattctgcctttttaaaagggaagactgaattctagggaggagaggcaccagctctctgggctgggcaggtctccaagctggcagggccacagcctcccgacggtcttgcctctagcatatttcttccagaagccacatttccacaggtgggcagctctaactgggagaaaatcttcctgagatttagccaaattagctttctttctttctttttttttttttgagatggagtctcactctgctgcccaggctggagtgcagtggcgcaatctcrgctcactgcaatctctgcctcccgggttcaagtgattctcctgcctcaacctcccgagtagctgggatttcaggcacacaccaccacgcctggctaatttttgtatttttattagcaatggggtttcaccatgctggccagactggtctcaaactcctgacctagggtgatccgcccacctcagcctcccaaagtgctggtattacaggtgtgagccaccgtgcccagcccaaattagctttctaggagcttccactttctgagtctgtttctgcctcttggaggtagtgaccatctccc

SEQ ID NO: 767 - DNA, 601 bp, Human
caatgttattcactgcccagtttagaatttcccttttggttcccattttaagacttatttaattatatgctttttaaatttttgagacagatagaattttttaagttatctttttattgttgatttctaaatttggtcatcatggttgttgtggtcaatatatgtggttcctataatatcagtggtagagaatttgctgagatctttataggattttctggtcatttttttcctcttgtgtttgaaaagaatgtatattttctgttgggtataaggttctagaaatgtatctatttgatcmagctagctattatattatctatatttgttatgtcactatgtggttttttttttttttacctgatttacctcccaccgtaatacaattacaattcaccataatagaggctttgttaagttctccttttgagtctgtcagttttttgctttatttttgaagctatgttgttaagtgcatagccatatgagtagaataagggttcaggatttttatacctttttggtgaattgttgcattttcccgagtagctgggactacagatgtgcactaccacgcctagctgatgtttgtgttttttgt

SEQ ID NO: 768 - DNA, 601 bp, Human
attttaagacttatttaattatatgctttttaaatttttgagacagatagaattttttaagttatctttttattgttgatttctaaatttggtcatcatggttgttgtggtcaatatatgtggttcctataatatcagtggtagagaatttgctgagatctttataggattttctggtcatttttttcctcttgtgtttgaaaagaatgtatattttctgttgggtataaggttctagaaatgtatctatttgatcaagctagctattatattatctatatttgttatgtcactatgtggttttttttttttttacctgatttacctcccaccgtaatacaattacaattcaccataatagaggctttgttaagttctccttttgagtctgtcagttttttgctttatttttgaagctatgttgttaagtgcatagccatatgagtagaataagggttcaggatttttatacctttttggtgaattgttgcattttcccgagtagctgggactacagatgtgcactaccacgcctagctgatgtttgtgttttttgtagagatgggatttcgctatgtttcccgggccagtctcaaactcc

SEQ ID NO: 769 - DNA, 601 bp, Human
ttgctccactgcactccagtctaggtgacagagtgagacattctcaaaaaaacaaaaacaaaaaaaccatccaccttctctcttctaatacttactcaagacatcattgtcatgaattctattttattgatgtcagtactcctgtactaataagccagatgagttaaaaacaacagcagccttgcaaccagccatgaagcaagtgatcttattctcatttcacagatgaggagactgaggctctgagtggactccagcctgccacggtctcccaccgagtcaggttggagcctgcacttargcccagagttatgcttctgtgtctcagatgcttgggggtccctgcccacaaaggtggcccccatgtctgtgtgtccccacccatccaggaatggtatggggtgagacaacaggaagagctccatgggtagtccccacccactgccttccatatgccagtctgcaagcagaaaatgaacgggaagctcttacctgtgcccatgtgttgtcctggctttgggtttgcccagggggcaaagtcctggtcattgttgagacaagttcactgctgctgagggccgagcaaatggtgacaaaggcc

SEQ ID NO: 770 - DNA, 601 bp, Human
ccccagcaaatctgcttctcttctcggctctccatcgtgggaagggtccctgggatcctccccaccaccccagcctgaggccactttccctctgtccccgctctccccagcctgctttccccaccaagcgccaccaagtccctgctgcctcctcctcccaaacaggctcaaacctgccccctcttcgccagctctcagctcagcccgctcctctcctgcttaagagccttcactggctccccactgccctagagacagagtttgagtctactgccatggcttggcagacgatgttgtcccyggcctgccaaccttccagctgccatcccagccagtccttctcccccttgctccagccaagggccccgcttgtagggtgggaagtgggccgtgccctccctcctgcctgcctattcgctgggtcttccctcattccctccctcaccccgccctctcataagaaccttcagaatctgccagacgcagtggctcacgcctgtaatcccagcactttgggaggctgaggtgggtggatcacctgaggtcaggagtttgagaccagcttggccaacatggcaaaaccctgtgtctgctaaaaata

SEQ ID NO: 771 - DNA, 601 bp, Human
acttaatctcccccgagttttttaaaaaaagtgagtcaagtgtgttctcctggtggcgggcgtgttttcccaggcccatgcttctgctcatttcctggctgcggccttcactgactttgctgcttcctaactctgtgaccttggccttgtcacttgctgtctctgggtctcaggccaatgggtctcaggccagtggggctccccggacaaagttccagggttttggggactgcatttcaagggtcagcaaccacagtccttaaacacgtggattttggagtgacaatgcctaggttatggytctgtgaccaccagcaagtgctctagcctttttgtgcctcagtcttctcatcagtaaaatgggaatgttaatggcacctacctcatagggtcgttgggagaaccaaattgattaatatattgtaagtacttagaacagggccaggcacaaaataagtactgcatatacagttaactatggacaaaagcttgggacctggttcatgtttaaaaatgattattgaggccaggtgcggtagctcatgcctgtaatcccagcactatgggaggctgaggcaggcggatcaggaggtcaagagat

SEQ ID NO: 772 - DNA, 601 bp, Human
ttgtttagaagtgtgcggcacctccctcctctctcttgccctggctgtcaccatgtacgcctgctcccctcttgccttccccgtgaataaaagctccctgaggcctccccagaagccaagtagatacgggtgctatgcttcctgtacagcctgcagagccataagccaattaaacctcttttctttgtaaattactcagtctcagatatttctttatagcaatgcaaaaatggactaacacacttgagttctgtctttttcttatggcatattttaatctaggccagacacagtggctcaygcctgtaatcccagcactttggaggccaaggcgggtggatcacttgaggtcaggagtttaagaccagcctggccaacatggggaaaccctgtctctactaaaaacacaaaaaattagttgggtgtggtggcacacacctgtaattccagctactcgagaggctgagacacaagaatcgcttgaacccgggaggtggaggttgcagtgagccgacatcacgccactgctctccagcttggggaacagagcaaacctccgtctcaaaaaaaaaaaaaaaaatctagggaagttgaaaacatt

SEQ ID NO: 773 - DNA, 601 bp, Human
ggccaaggcgggtggatcacttgaggtcaggagtttaagaccagcctggccaacatggggaaaccctgtctctactaaaaacacaaaaaattagttgggtgtggtggcacacacctgtaattccagctactcgagaggctgagacacaagaatcgcttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctrtctgcatcttgaaataaaataaacattcatacatgtaacctcattaatctgattagagatagtgataagtactgggacagacataaacagggtgctgtgataagaagtcacagggagggcccgcattagttgaggggggtcagagaaggcttctgaagtgtttctggtgcaaatgcttggaaaagggagagctgggagtgtatcccagggctgaggccaatggaggattgcagaagagggagaggggataggaggggaatgttagagggataagcaggggaattggctcttttcttcatt

SEQ ID NO: 774 - DNA, 601 bp, Human
gggagtgtatcccagggctgaggccaatggaggattgcagaagagggagaggggataggaggggaatgttagagggataagcaggggaattggctcttttcttcattttcttaaattaaactttttattttcagataattaaagatttacacacagctggaagaaatcatagagaagccgggcgtggtggctcatgcctataatcccagcacttttggaggctgaggcgggcagatcacttgagatcaggagttcgagaccagcctggtcagtatgatgaaaccccatctctactaaaaayacaaaaattagttgggcatggtggcttgcctgtagtcccagctactggggaggctgaggcaggagaatcacttgagcctaggaggtagaggttgcagtgagccgagatcacaccactgcactccagcctgggcaacagagtgagactccatctcaaaaaaaaaaaaaagaaaagaaaaagaaaaagaaatcacagagagacccctgcttctatgctgttccccccgagggcaagattgtagaaatctgtaatacagtatcacagctgggatactgacactgatataagctactgacctta

SEQ ID NO: 775 - DNA, 601 bp, Human
catggttatgtgatttcaagtatgttacataaatggagtcacggggtgtgtactctgggaactggcttttttcactctagggcttggattttattctaagtcagagatgcttctctaatgagctgtgaaccccctggggatctgtggcccctgtgaagaagccctttaggagccagggggcattggatgtgtgagctggccctggtctcatttctgattttaaaatggctctggctgtgatgtggagaagaggcagggtgagcctcatctgcagcaactgctaactgcccacatccccccrgacttctcaaaaatttgccactcccctgctcaaagaccctcaaaagctgcccactgcttagaggacaggcctttgacctgaggtcctcacttgggcttcagggattctgtgaacccctaaaatggaatgcagaattaagtgtatgcaccttgccagaaacagggtttggggtttacattagatgctcagataggtcattgatccccaaaacactaaggtctctgacttctagacagatagtagttaagaaccaaagctttggagcttgagtgctggatttaagacccatgactgtcacag

SEQ ID NO: 776 - DNA, 601 bp, Human
tggttatgtgatttcaagtatgttacataaatggagtcacggggtgtgtactctgggaactggcttttttcactctagggcttggattttattctaagtcagagatgcttctctaatgagctgtgaaccccctggggatctgtggcccctgtgaagaagccctttaggagccagggggcattggatgtgtgagctggccctggtctcatttctgattttaaaatggctctggctgtgatgtggagaagaggcagggtgagcctcatctgcagcaactgctaactgcccacatccccccagmcttctcaaaaatttgccactcccctgctcaaagaccctcaaaagctgcccactgcttagaggacaggcctttgacctgaggtcctcacttgggcttcagggattctgtgaacccctaaaatggaatgcagaattaagtgtatgcaccttgccagaaacagggtttggggtttacattagatgctcagataggtcattgatccccaaaacactaaggtctctgacttctagacagatagtagttaagaaccaaagctttggagcttgagtgctggatttaagacccatgactgtcacagct

SEQ ID NO: 777 - DNA, 601 bp, Human
gttatgtgatttcaagtatgttacataaatggagtcacggggtgtgtactctgggaactggcttttttcactctagggcttggattttattctaagtcagagatgcttctctaatgagctgtgaaccccctggggatctgtggcccctgtgaagaagccctttaggagccagggggcattggatgtgtgagctggccctggtctcatttctgattttaaaatggctctggctgtgatgtggagaagaggcagggtgagcctcatctgcagcaactgctaactgcccacatccccccagacttctcaaaaatttgccactcccctgctcaaagaccctcaaaagctgcccactgcttagaggacaggcctttgacctgaggtcctcacttgggcttcagggattctgtgaacccctaaaatggaatgcagaattaagtgtatgcaccttgccagaaacagggtttggggtttacattagatgctcagataggtcattgatccccaaaacactaaggtctctgacttctagacagatagtagttaagaaccaaagctttggagcttgagtgctggatttaagacccatgactgtcacagctgt

SEQ ID NO: 778 - DNA, 601 bp, Human
ttaaaatggctctggctgtgatgtggagaagaggcagggtgagcctcatctgcagcaactgctaactgcccacatccccccagacttctcaaaaatttgccactcccctgctcaaagaccctcaaaagctgcccactgcttagaggacaggcctttgacctgaggtcctcacttgggcttcagggattctgtgaacccctaaaatggaatgcagaattaagtgtatgcaccttgccagaaacagggtttggggtttacattagatgctcagataggtcattgatccccaaaacactaaggwctctgacttctagacagatagtagttaagaaccaaagctttggagcttgagtgctggatttaagacccatgactgtcacagctgtgcaacctcagacaaatcactcagcctttctgtgccttggtttcctcatctgaaaatggagaaaataatattacctatttcatagattattaaatgcattcttgtatgtaaaagatgtaaaagaaaacttggcatgtggtaaactctgtgtgtttaagtgaatggtgaggctgcccagtataggagggcagagctttccaggtaaagactttctag

SEQ ID NO: 779 - DNA, 601 bp, Human
gccttacatattttgaccctttgttgttagttgcctacacattaaggattgttatttacatcttcttggagaattaactcccgaatcattatatagtgccacttttttttaatttaaaaattttattttttattttttgagacaggatctttctctgttgcccaggctggagttcagtggcatgaacacagcccactgcagccttaacctcctgggctcaagtgatcctcctgcctcagccttcccagtagctggggctacaggcatgtgccacctctaataacttttctttaatttacartagtattagtttgttctcatgctgctctaaggacatgcccaagactgggtaatttataaaggaaagaggtttgactcacagttctgcagggctggggaggcttcaggaaacatattatcatggcggaaagggaagcaaagacatcctttttcacatgacgtcaggaaggagacacgccaaggaaagggggggaaagccctttataaaaccatcagatctcaggagaactcactcactgtcacgaaaacagcatgggggaactgctcccgtaatctaatcacctcccatgaggtccttccc

SEQ ID NO: 780 - DNA, 601 bp, Human
acacattaaggattgttatttacatcttcttggagaattaactcccgaatcattatatagtgccacttttttttaatttaaaaattttattttttattttttgagacaggatctttctctgttgcccaggctggagttcagtggcatgaacacagcccactgcagccttaacctcctgggctcaagtgatcctcctgcctcagccttcccagtagctggggctacaggcatgtgccacctctaataacttttctttaatttacaatagtattagtttgttctcatgctgctctaaggacaygcccaagactgggtaatttataaaggaaagaggtttgactcacagttctgcagggctggggaggcttcaggaaacatattatcatggcggaaagggaagcaaagacatcctttttcacatgacgtcaggaaggagacacgccaaggaaagggggggaaagccctttataaaaccatcagatctcaggagaactcactcactgtcacgaaaacagcatgggggaactgctcccgtaatctaatcacctcccatgaggtccttcccccaacacgtggggattacaattcatattacaattca

SEQ ID NO: 781 - DNA, 601 bp, Human
aagggggggaaagccctttataaaaccatcagatctcaggagaactcactcactgtcacgaaaacagcatgggggaactgctcccgtaatctaatcacctcccatgaggtccttcccccaacacgtggggattacaattcatattacaattcaaggtgagatttgggtggggacacagagccaggccatatcacattattattaattagtgccttctctctcatttttttgattcgcctaggtagagatttatcaatttcattgatcttttcgaagaaccaatttttgatttcattgattytcctcgattaattttctatttttaatttcattgatgtatgctccaattttgtatttttttcttctgcttgttttagacatatattgcttttctgtttctagtactctagatggaaacagattattgattttagaactttctttctaagatatacattcaataatataaatttccctctaagcactgcttttgctacgtctcaccgattttgataggctatattttcatttttatttagttaaaaatatttttagtttctcttgtgatttcttctttgatccatatgttattcggaagtgt

SEQ ID NO: 782 - DNA, 601 bp, Human
cctaggtagagatttatcaatttcattgatcttttcgaagaaccaatttttgatttcattgattttcctcgattaattttctatttttaatttcattgatgtatgctccaattttgtatttttttcttctgcttgttttagacatatattgcttttctgtttctagtactctagatggaaacagattattgattttagaactttctttctaagatatacattcaataatataaatttccctctaagcactgcttttgctacgtctcaccgattttgataggctatattttcatttttattkagttaaaaatatttttagtttctcttgtgatttcttctttgatccatatgttattcggaagtgtgtttttaaatctccaaatacttggaaattttctggctttcttcctgctagtgacttctaatttgaatccattgtggcctaagagcatatgttgtgtgatttctaatgttttcaatctcttaaggttgttttatgtcccagaatgtggtctgtcttggtgattattccacatgaacctgaggagaatgtatattctgctgttgtgagatgtaacagtctataaatggatacctctgt

SEQ ID NO: 783 - DNA, 601 bp, Human
gctgtgggacctggtggatgggttatttggcctctctggcctcagtttccttagctagacagttgggataacagcctacctttcaggattcttgtgtggattcggtgaggtaatacttctaaagcacctagcaaagtgtcaagtacaaggtaagtgctgggcaagcagggattttgttcacacaaagccttgactcaacataaggaggctgtttccaatggctctgcttaactgagacctgagagtgattgctccatctgtggtggcatatgggctgaaactgcctagcagcatgtcagargtggggtgttcgcaggacatccttgtccaggttggcagttgagcttggcaggtgaccgctgagaccccttccaactccaccacttcaggaatctcttttttttttttctgagacagtcttgctctgtcacccaggctggagtgcagtggctcaatcttggctcactgcaagctccgcctcccgggttcaagccattctcctgcctcagcctcctgagtagctgggactacaggcacccgccaccacgcccagctaattttttgtatttttagtagagactgagtttcaccatgttagcca

SEQ ID NO: 784 - DNA, 601 bp, Human
ctgagagtgattgctccatctgtggtggcatatgggctgaaactgcctagcagcatgtcagaagtggggtgttcgcaggacatccttgtccaggttggcagttgagcttggcaggtgaccgctgagaccccttccaactccaccacttcaggaatctcttttttttttttctgagacagtcttgctctgtcacccaggctggagtgcagtggctcaatcttggctcactgcaagctccgcctcccgggttcaagccattctcctgcctcagcctcctgagtagctgggactacaggcaccygccaccacgcccagctaattttttgtatttttagtagagactgagtttcaccatgttagccaggatggtctcgatctcctgacctcatgatctgcctgcctcagcctcccgaagtgctgggattacaggcgtgagccaccgcgcccagccaggagtctcttgatttagaatgggaacttgaaatcatctcctcttgccgtgtacttgaacgcgataacctggcacttatctttttaattcttttactcacctgcatctttgttctttttgcctctgatgttcagggaagcctcttctccc

SEQ ID NO: 785 - DNA, 601 bp, Human
atgatctgcctgcctcagcctcccgaagtgctgggattacaggcgtgagccaccgcgcccagccaggagtctcttgatttagaatgggaacttgaaatcatctcctcttgccgtgtacttgaacgcgataacctggcacttatctttttaattcttttactcacctgcatctttgttctttttgcctctgatgttcagggaagcctcttctcccactgcatctgtgatctctcctgaaatgtagcacccacacatccctgagaagctagctgcggcacgtgtgtgtgcacatgggcatgcrtaagtctgggcgtgccttccacaacagattaaggatatcaatcctgacgccatgctgggatgttttagtgaatcttgacagggttgttgactcccctgtttccctggaggactttaccatgaaagtcttctgctgtgtgactttggacaggcgtcttggcctctctgtttctctttattcataattgaggctaaagtgacacctttgccatctctgccacaggatactgtgggcatctgtgtagttgtgagagtaaaagttactaggacttgccaaggaaatcagtgtcaggaacccacc

SEQ ID NO: 786 - DNA, 601 bp, Human
ggtgcacatctgtggtcccagctactcaggaggctgaggtgggaagattgcttgagcccgggaggtggaggttgcagggagtcgaggttgtgccactacactctagcttgggtaacagagtaaactctgtctcaaaaaaaaaaaaaaaaaaaaggaaagggaggaagggaaggtccctccaggtggaggggacagagagagaaaaggcatggaggtgggactgagtttggtgtgtttaagaagtgcaggtggcagccgggctcagtggctcacgcctgtaatcccagcactttgggaggcygaggcaggcggatcacctggggtcgggagttcaagaccagcctgaccagcatggagaaaccctgtctctactaaaaatacaaaattagttgggtgtgtggcccatgcctgtaatcccagctactcagaaggctgaggcaggagaatcgcttgaacctgggaggcggaggttgcagtgagccgagatcgcgccattgcactccagcctgggcaacaagagtgaaactctgtctcaaaaaaataaaatgaaataaaataaaataaaatgttaaaaaacaaaaaagaagaagtgtaggtggca

SEQ ID NO: 787 - DNA, 601 bp, Human
agggaggaagggaaggtccctccaggtggaggggacagagagagaaaaggcatggaggtgggactgagtttggtgtgtttaagaagtgcaggtggcagccgggctcagtggctcacgcctgtaatcccagcactttgggaggctgaggcaggcggatcacctggggtcgggagttcaagaccagcctgaccagcatggagaaaccctgtctctactaaaaatacaaaattagttgggtgtgtggcccatgcctgtaatcccagctactcagaaggctgaggcaggagaatcgcttgaaccygggaggcggaggttgcagtgagccgagatcgcgccattgcactccagcctgggcaacaagagtgaaactctgtctcaaaaaaataaaatgaaataaaataaaataaaatgttaaaaaacaaaaaagaagaagtgtaggtggcaggcgtaggatgcatgggtgctgggcccaggtggagagggaggtggagccctgctggggggagggccttcaagtgtgcccaagtcactcggagagcatccagcaggggcctagagctcctgaggtggccttaagttcttatgatgccccagacactgc

SEQ ID NO: 788 - DNA, 601 bp, Human
ggaggttgcagtgagccgagatcgcgccattgcactccagcctgggcaacaagagtgaaactctgtctcaaaaaaataaaatgaaataaaataaaataaaatgttaaaaaacaaaaaagaagaagtgtaggtggcaggcgtaggatgcatgggtgctgggcccaggtggagagggaggtggagccctgctggggggagggccttcaagtgtgcccaagtcactcggagagcatccagcaggggcctagagctcctgaggtggccttaagttcttatgatgccccagacactgcacacagtrcttcagaggcaacacctccgttcctgtttgctgcaagcctgtgaggttagccttggaaccattcctgtgccacagaaacacagccagagcaccaaaagagaaatgctgttaatggcaaagaactactcactagcagaacaaagcctgggagctgcttttttgaataagatcccaggagagagacccaagcgggaagtgaaggatgggcacttgaaatgttgcagggaatataacccagcgcgtgctgttttctttttttctttttcttttttttttttttctctttttgcaacagggtct

SEQ ID NO: 789 - DNA, 601 bp, Human
ttcttttcttttcttttttttttatgacagggtcttgctggagtgcagtggtacggtcttggcttactgcagccttgacatcccaggctcaaacgatcttcccacctcaacctcccaagtagctaggattacaggcatgcaccaccgtgcctggctgattttgtttaatttttgtagagataaggtctcactctgttgcccaggctggtcttgaactcctgggctcaagccatcctccctccttagcctcccaaagtgctgggattacaggtgtgagccaccacacctggcttctgaacattttttcttaatgataatagctggtgctatgggctgaatgtgttcccccaaattcatatgttgaaacttcatcccattgtagtcatattaagagatggggcctttggagaagtgattaagtcatgagggctctgtggttggtcatgaatggggttagtgcccttatgaacgggctgaaggaagtgtgtttgccccttctgtcatatgaagacacagcagcatggcatcgtccgtgaggaatgggctctcaccagatctggatctcctagtgtcgtgatcttggacttcccagtctccagaa

SEQ ID NO: 790 - DNA, 601 bp, Human
tttaatttttgtagagataaggtctcactctgttgcccaggctggtcttgaactcctgggctcaagccatcctccctccttagcctcccaaagtgctgggattacaggtgtgagccaccacacctggcttctgaacattttttcttaatgataatagctggtgctatgggctgaatgtgttcccccaaattcatatgttgaaacttcatcccattgtagtcatattaagagatggggcctttggagaagtgattaagtcatgagggctctgtggttggtcatgaatggggttagtgccctyatgaacgggctgaaggaagtgtgtttgccccttctgtcatatgaagacacagcagcatggcatcgtccgtgaggaatgggctctcaccagatctggatctcctagtgtcgtgatcttggacttcccagtctccagaactatgcattagaaaatttatttatttattatttatttattttgagatggagtcttgctcttgtcgcccaggctggagtacaatgacgcgatctcgactcactgcaacctctgcctaccccagttcaagcgattctcctgcctcagcctccagagtagctggaa

SEQ ID NO: 791 - DNA, 601 bp, Human
gctgatctcgaactcctgacctcaggtgatccacccaccttggctccccaaagtgctggaaatacaggtgtgagctactgtgtctggcctgaataataaaatttaaaacaatttttcaaaaattcaccatgaggtctcactatattccctaggctggtctcaaacccctggactccaagtgatccaccccaccttcccgagtagctgggactagagatgcacaccattgcacccaatagagcaatacgtttctgttctttgtaaattacctgctctaaggtatttttgttatagcagcctrtatggactaagctgacttgtaacgttacttgagactttaaagtgttccggtcactgttggagggctctgtctgtgttagctcatttaatccccacaacacctcaatcagatggggctattcttagtcccactttatagataaggaaactgaggcatggaagcacagcttgctcaaggttcacatctagtcagtgacagagcaggtatttaaacctcaggaaataatcagagaaacatgtgtagagggttgtccaaggaaggccacatccagaagcatctcccaggacagttgttgtgtag

SEQ ID NO: 792 - DNA, 601 bp, Human; identical to SEQ ID NO: 40

SEQ ID NO: 793 - DNA, 601 bp, Human; identical to SEQ ID NO: 41

SEQ ID NO: 794 - DNA, 601 bp, Human; identical to SEQ ID NO: 42

SEQ ID NO: 795 - DNA, 601 bp, Human; identical to SEQ ID NO: 43

SEQ ID NO: 796 - DNA, 601 bp, Human; identical to SEQ ID NO: 44

SEQ ID NO: 797 - DNA, 601 bp, Human; identical to SEQ ID NO: 45

SEQ ID NO: 798 - DNA, 601 bp, Human; identical to SEQ ID NO: 46

SEQ ID NO: 799 - DNA, 601 bp, Human; identical to SEQ ID NO: 47

SEQ ID NO: 800 - DNA, 601 bp, Human; identical to SEQ ID NO: 48

SEQ ID NO: 801 - DNA, 601 bp, Human; identical to SEQ ID NO: 49

SEQ ID NO: 802 - DNA, 601 bp, Human; identical to SEQ ID NO: 50

SEQ ID NO: 803 - DNA, 601 bp, Human; identical to SEQ ID NO: 51

SEQ ID NO: 804 - DNA, 601 bp, Human; identical to SEQ ID NO: 52

SEQ ID NO: 805 - DNA, 601 bp, Human; identical to SEQ ID NO: 53

SEQ ID NO: 806 - DNA, 601 bp, Human; identical to SEQ ID NO: 54

SEQ ID NO: 807 - DNA, 601 bp, Human; identical to SEQ ID NO: 55

SEQ ID NO: 808 - DNA, 601 bp, Human; identical to SEQ ID NO: 56

SEQ ID NO: 809 - DNA, 601 bp, Human; identical to SEQ ID NO: 57

SEQ ID NO: 810 - DNA, 601 bp, Human; identical to SEQ ID NO: 58

SEQ ID NO: 811 - DNA, 601 bp, Human; identical to SEQ ID NO: 59

SEQ ID NO: 812 - DNA, 601 bp, Human; identical to SEQ ID NO: 60

SEQ ID NO: 813 - DNA, 601 bp, Human; identical to SEQ ID NO: 61

SEQ ID NO: 814 - DNA, 601 bp, Human; identical to SEQ ID NO: 62

SEQ ID NO: 815 - DNA, 601 bp, Human; identical to SEQ ID NO: 63

SEQ ID NO: 816 - DNA, 601 bp, Human; identical to SEQ ID NO: 64

SEQ ID NO: 817 - DNA, 601 bp, Human; identical to SEQ ID NO: 65

SEQ ID NO: 818 - DNA, 601 bp, Human; identical to SEQ ID NO: 66

SEQ ID NO: 819 - DNA, 601 bp, Human; identical to SEQ ID NO: 67

SEQ ID NO: 820 - DNA, 601 bp, Human; identical to SEQ ID NO: 68

SEQ ID NO: 821 - DNA, 601 bp, Human; identical to SEQ ID NO: 69

SEQ ID NO: 822 - DNA, 601 bp, Human; identical to SEQ ID NO: 70

SEQ ID NO: 823 - DNA, 601 bp, Human; identical to SEQ ID NO: 71

SEQ ID NO: 824 - DNA, 601 bp, Human; identical to SEQ ID NO: 72

SEQ ID NO: 825 - DNA, 601 bp, Human; identical to SEQ ID NO: 73

SEQ ID NO: 826 - DNA, 601 bp, Human; identical to SEQ ID NO: 74

SEQ ID NO: 827 - DNA, 601 bp, Human; identical to SEQ ID NO: 75

SEQ ID NO: 828 - DNA, 601 bp, Human; identical to SEQ ID NO: 76

SEQ ID NO: 829 - DNA, 601 bp, Human; identical to SEQ ID NO: 77

SEQ ID NO: 830 - DNA, 601 bp, Human; identical to SEQ ID NO: 78

SEQ ID NO: 831 - DNA, 601 bp, Human; identical to SEQ ID NO: 79

SEQ ID NO: 832 - DNA, 601 bp, Human; identical to SEQ ID NO: 80

SEQ ID NO: 833 - DNA, 601 bp, Human; identical to SEQ ID NO: 81

SEQ ID NO: 834 - DNA, 601 bp, Human; identical to SEQ ID NO: 82

SEQ ID NO: 835 - DNA, 601 bp, Human; identical to SEQ ID NO: 83

SEQ ID NO: 836 - DNA, 601 bp, Human; identical to SEQ ID NO: 84

SEQ ID NO: 837 - DNA, 601 bp, Human; identical to SEQ ID NO: 85

SEQ ID NO: 838 - DNA, 601 bp, Human; identical to SEQ ID NO: 86

SEQ ID NO: 839 - DNA, 601 bp, Human; identical to SEQ ID NO: 87

SEQ ID NO: 840 - DNA, 601 bp, Human; identical to SEQ ID NO: 88

SEQ ID NO: 841 - DNA, 601 bp, Human; identical to SEQ ID NO: 89

SEQ ID NO: 842 - DNA, 601 bp, Human; identical to SEQ ID NO: 90

SEQ ID NO: 843 - DNA, 601 bp, Human; identical to SEQ ID NO: 91

SEQ ID NO: 844 - DNA, 601 bp, Human; identical to SEQ ID NO: 92

SEQ ID NO: 845 - DNA, 601 bp, Human; identical to SEQ ID NO: 93

SEQ ID NO: 846 - DNA, 601 bp, Human; identical to SEQ ID NO: 94

SEQ ID NO: 847 - DNA, 601 bp, Human; identical to SEQ ID NO: 95

SEQ ID NO: 848 - DNA, 601 bp, Human; identical to SEQ ID NO: 96

What is claimed is:

1. A detection reagent selected from the group consisting of:
   (a) a detection reagent consisting of a segment of SEQ ID NO:689, wherein the segment comprises at least 90 contiguous nucleotides of SEQ ID NO:689, wherein the at least 90 contiguous nucleotides include position 301 of SEQ ID NO:689, and wherein position 301 of SEQ ID NO;689 is 'G';
   (b) a detection regent consisting of a segment of SEQ ID NO:689, wherein the segment comprise at least 90 contiguous nucleotides of SEQ ID NO:689, wherein the at least 90 contiguous nucleotides include position 301 of SEQ ID NO:689, and wherein position 301 of SEQ ID NO:689 is 'A'; and
   (c) a detection reagent which is entirely complementary to the detection reagent of (a) or (b).

2. An isolated polynucleotide selected from the group consisting of:
   (a) an isolated polynucleotide consisting of a segment of SEQ ID NO:689, wherein the segment comprises at least 100 contiguous nucleotides of SEQ ID NO:689, and wherein the at least 100 contiguous nucleotides include position 301 of SEQ ID NO:689, and wherein position 301 of SEQ ID NO:689 is 'G';
   (b) an isolated polynucleotide consisting of a segment of SEQ ID NO:689, wherein the segment comprises at least 100 contiguous nucleotides of SEQ ID NO:689, and wherein the at least 100 contiguous nucleotides includes position 301 of SEQ ID NO:689, and wherein position 301 of SEQ ID NO:689 is 'A'; and
   (c) an isolated polynucleotide which is entirely complementary to the isolated polynucleotide of (a) or (b).

3. An isolated polynucleotide consisting of a nucleotide sequence selected from the group consisting of:
   (a) the nucleotide sequence of SEQ ID NO:689, wherein position 301 of SEQ ID NO:689 is 'G';
   (b) the nucleotide sequence of SEQ ID NO:689, wherein position 301 of SEQ ID NO:689 is 'A'; and
   (c) a nucleotide sequence which is entirely complementary to the nucleotide sequence of (a) or (b).

4. The detection reagent of claim 1 wherein position 301 of SEQ ID NO:689 is at the center of the detection reagent.

5. The detection reagent of claim 1 wherein position 301 of SEQ ID NO:689 is at the 3' end of the detection reagent.

6. The detection reagent of claim 1 wherein the detection reagent is detectably labeled.

7. The detection reagent of claim 6, wherein the detection reagent is labeled with a reporter.

8. The detection reagent of claim 7, wherein the reporter is fluorescent.

9. The detection reagent of 7, wherein the detection reagent is further labeled with a quencher.

10. The detection reagent of claim 1, wherein the detection reagent is bound to a solid support.

11. The detection reagent of claim 10, wherein the solid support comprises a nucleic acid array.

12. An isolated polynucleotide, wherein the nucleotide sequence of said polynucleotide consists of SEQ ID NO:12 or the complement thereof.

13. An isolated polynucleotide, wherein the nucleotide sequence of said polynucleotide consists of SEQ ID NO:12 in which nucleotide 27 of SEQ ID NO:12 is 'C', or the complement of said nucleotide sequence.

14. An isolated polynucleotide, wherein the nucleotide sequence of said polynucleotide consists of a nucleotide sequence that encodes a polypeptide having an amino acid sequence consisting of SEQ ID NO:25, or the complement of said nucleotide sequence.

15. An isolated polynucleotide, wherein the nucleotide sequence of said polynucleotide consists of a nucleotide sequence that encodes a polypeptide having an amino acid sequence consisting of SEQ ID NO:25 in which residue 9 of SEQ ID NO:25 is proline, or the complement of said nucleotide sequence.

* * * * *